United States Patent
Nezu et al.

(10) Patent No.: US 9,975,966 B2
(45) Date of Patent: May 22, 2018

(54) CYTOTOXICITY-INDUCING THERAPUTIC AGENT

(71) Applicant: Chugai Seiyaku Kabushiki Kaisha, Tokyo (JP)

(72) Inventors: Junichi Nezu, Shizuoka (JP); Atsushi Narita, Shizuoka (JP); Takahiro Ishiguro, Kanagawa (JP); Mika Sakurai, Shizuoka (JP); Hirotake Shiraiwa, Shizuoka (JP); Naoka Hironiwa, Shizuoka (JP); Tomoyuki Igawa, Shizuoka (JP); Yumiko Kawai, Kanagawa (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 0 days. days.

(21) Appl. No.: 15/467,654

(22) Filed: Mar. 23, 2017

(65) Prior Publication Data
US 2017/0267783 A1    Sep. 21, 2017

Related U.S. Application Data

(63) Continuation of application No. PCT/JP2015/077024, filed on Sep. 25, 2015.

(30) Foreign Application Priority Data

Sep. 26, 2014  (JP) .................................. 2014-197315

(51) Int. Cl.
| | |
|---|---|
| *C07K 16/46* | (2006.01) |
| *C07K 16/30* | (2006.01) |
| *C07K 16/28* | (2006.01) |
| *A61K 39/00* | (2006.01) |

(52) U.S. Cl.
CPC ........ *C07K 16/468* (2013.01); *C07K 16/2809* (2013.01); *C07K 16/30* (2013.01); *A61K 2039/505* (2013.01); *C07K 2317/24* (2013.01); *C07K 2317/31* (2013.01); *C07K 2317/34* (2013.01); *C07K 2317/71* (2013.01); *C07K 2317/73* (2013.01); *C07K 2317/92* (2013.01)

(58) Field of Classification Search
CPC .............. C07K 16/468; C07K 16/2809; C07K 2317/31
See application file for complete search history.

(56) References Cited

U.S. PATENT DOCUMENTS

| | | |
|---|---|---|
| 4,208,479 A | 6/1980 | Maggio et al. |
| 4,444,878 A | 4/1984 | Paulus |
| 4,474,893 A | 10/1984 | Reading |
| 5,322,678 A | 6/1994 | Morgan, Jr. et al. |
| 5,496,549 A | 3/1996 | Yamazaki et al. |
| 5,530,101 A | 6/1996 | Queen et al. |
| 5,591,828 A | 1/1997 | Bosslet et al. |
| 5,639,641 A | 6/1997 | Pedersen et al. |
| 5,744,446 A | 4/1998 | Lollar et al. |
| 5,795,965 A | 8/1998 | Tsuchiya et al. |
| 5,990,286 A | 11/1999 | Khawli et al. |
| 6,005,091 A | 12/1999 | Blackburn et al. |
| 6,010,902 A | 1/2000 | Ledbetter et al. |
| 6,025,165 A | 2/2000 | Whitlow et al. |
| 6,165,745 A | 12/2000 | Ward et al. |
| 6,210,670 B1 | 4/2001 | Berg |
| 6,214,973 B1 | 4/2001 | Ohtomo et al. |
| 6,327,353 B1 | 12/2001 | Fukuzawa et al. |
| 6,329,511 B1 | 12/2001 | Vasquez et al. |
| 6,485,943 B2 | 11/2002 | Stevens et al. |
| 6,617,156 B1 | 9/2003 | Doucette-Stamm et al. |
| 6,677,436 B1 | 1/2004 | Sato et al. |
| 6,737,056 B1 | 5/2004 | Presta |
| 6,884,879 B1 | 4/2005 | Baca et al. |
| 6,913,747 B1 | 7/2005 | Co et al. |
| 7,033,590 B1 | 4/2006 | Scheiflinger et al. |
| 7,276,585 B2 | 10/2007 | Lazar et al. |
| 7,297,775 B2 | 11/2007 | Idusogie et al. |
| 7,317,091 B2 | 1/2008 | Lazar et al. |
| 7,358,054 B2 | 4/2008 | Lyne et al. |
| 7,361,336 B1 | 4/2008 | Bergstein |
| 7,365,166 B2 | 4/2008 | Baca et al. |
| 7,427,400 B2 | 9/2008 | Bergstein |

(Continued)

FOREIGN PATENT DOCUMENTS

| | | |
|---|---|---|
| AU | 2009290162 A1 | 4/2010 |
| CA | 2019559 A1 | 12/1990 |

(Continued)

OTHER PUBLICATIONS

Sampei et al., PLoS ONE 8(2): e57479. doi:10.1371/journal.pone.0057479 (Year: 2013).*

Growe, G., et al., "Hemophilia and Von Willebrand's Disease: 2. Management" Canadian Medical Association Journal 153(2):147-157, Canadian Medical Association, Canada (Jul. 1995).

Amersdorfer P., et al., GenPept Accession No. AAC26541, dated Aug. 1, 2001.

Angal, S., et al., "A Single Amino Acid Substitution Abolishes the Heterogeneity of Chimeric Mouse/Human (IgG4) Antibody," Molecular Immunology 30(1):105-108, Pergamon Press, England (Jan. 1993).

Asselta, R. and Peyvandi, F., "Factor V Deficiency," Seminars in Thrombosis and Hemostasis 35(4):382-389, Thieme, United States (2009).

(Continued)

*Primary Examiner* — Jessica H Roark
(74) *Attorney, Agent, or Firm* — Nixon & Vanderhye P.C.

(57) ABSTRACT

Novel multispecific antigen-binding molecules maintaining excellent cellular cytotoxicity and high stability, which comprise a domain that contains an antibody variable region having glypican 3-binding activity and a domain that contains an antibody variable region having T-cell receptor complex-binding activity, were discovered. Since the molecules of the present invention show a strong cytotoxicity against cells and tissues expressing glypican 3, it is possible to produce novel pharmaceutical compositions for treating or preventing various cancers.

10 Claims, 15 Drawing Sheets

(56) References Cited

U.S. PATENT DOCUMENTS

| | | |
|---|---|---|
| 7,615,213 B2 | 11/2009 | Kasaian et al. |
| 7,662,925 B2 | 2/2010 | Lazar et al. |
| 7,691,586 B2 | 4/2010 | Watanabe et al. |
| 7,744,880 B2 | 6/2010 | Aburatani et al. |
| 7,797,974 B2 | 9/2010 | Kruger et al. |
| 7,867,734 B2 | 1/2011 | Nakano et al. |
| 7,871,613 B2 | 1/2011 | Kinoshita et al. |
| 7,919,086 B2 | 4/2011 | Nakano et al. |
| 7,955,590 B2 | 6/2011 | Gillies et al. |
| 8,039,592 B2 | 10/2011 | Lazar et al. |
| 8,263,077 B2 | 9/2012 | Aburatani et al. |
| 8,263,631 B2 | 9/2012 | Fujiwara et al. |
| 8,497,355 B2 | 7/2013 | Igawa et al. |
| 8,586,713 B2 | 11/2013 | Davis et al. |
| 8,592,562 B2 | 11/2013 | Kannan et al. |
| 8,663,929 B2 | 3/2014 | Kataoka |
| 8,937,158 B2 | 1/2015 | Lazar et al. |
| 9,096,651 B2 | 8/2015 | Igawa et al. |
| 9,102,739 B2 | 8/2015 | Lazar et al. |
| 9,527,926 B2 | 12/2016 | Ho et al. |
| 9,556,279 B2 | 1/2017 | Niwa et al. |
| 9,637,557 B2 | 5/2017 | Scheer et al. |
| 9,670,269 B2 | 6/2017 | Igawa et al. |
| 2002/0009430 A1 | 1/2002 | Lindhofer et al. |
| 2002/0062010 A1 | 5/2002 | Arathoon et al. |
| 2002/0102254 A1 | 8/2002 | Leung et al. |
| 2002/0137897 A1 | 9/2002 | Stevens et al. |
| 2002/0142374 A1 | 10/2002 | Gallo et al. |
| 2002/0164339 A1 | 11/2002 | Do Couto et al. |
| 2003/0045691 A1 | 3/2003 | Ono et al. |
| 2003/0103970 A1 | 6/2003 | Tsuchiya |
| 2003/0175884 A1 | 9/2003 | Umana et al. |
| 2003/0207346 A1 | 11/2003 | Arathoon et al. |
| 2003/0219441 A1 | 11/2003 | Thorpe et al. |
| 2003/0224297 A1 | 12/2003 | Maeda et al. |
| 2003/0224397 A1 | 12/2003 | Lowman et al. |
| 2004/0024320 A1 | 2/2004 | Karasawa et al. |
| 2004/0081651 A1 | 4/2004 | Karpusas et al. |
| 2004/0110226 A1 | 6/2004 | Lazar et al. |
| 2004/0132101 A1 | 7/2004 | Lazar et al. |
| 2004/0236080 A1 | 11/2004 | Aburatani |
| 2004/0258693 A1 | 12/2004 | Young et al. |
| 2005/0032759 A1 | 2/2005 | Massimini et al. |
| 2005/0054832 A1 | 3/2005 | Lazar et al. |
| 2005/0095243 A1 | 5/2005 | Chan et al. |
| 2005/0130224 A1 | 6/2005 | Saito et al. |
| 2005/0164307 A1 | 7/2005 | Kojima et al. |
| 2005/0171339 A1 | 8/2005 | Sugo et al. |
| 2005/0196397 A1 | 9/2005 | Scheiflinger et al. |
| 2005/0233392 A1 | 10/2005 | Filmus et al. |
| 2005/0244403 A1 | 11/2005 | Lazar et al. |
| 2005/0244416 A1 | 11/2005 | Jung |
| 2005/0261229 A1 | 11/2005 | Gillies et al. |
| 2005/0266425 A1 | 12/2005 | Zauderer et al. |
| 2006/0008456 A1 | 1/2006 | Tsuchiya |
| 2006/0014223 A1 | 1/2006 | Aburatani et al. |
| 2006/0019342 A1 | 1/2006 | Dall'Acqua et al. |
| 2006/0024298 A1 | 2/2006 | Lazar et al. |
| 2006/0040325 A1 | 2/2006 | Wu et al. |
| 2006/0063228 A1 | 3/2006 | Kasaian et al. |
| 2006/0088899 A1 | 4/2006 | Alvarez et al. |
| 2006/0159673 A1 | 7/2006 | Kojima |
| 2006/0167232 A1 | 7/2006 | Aburatani et al. |
| 2006/0188510 A1 | 8/2006 | Aburatani et al. |
| 2006/0193828 A1 | 8/2006 | Kosaka et al. |
| 2006/0246550 A1 | 11/2006 | Okumura |
| 2006/0287508 A1 | 12/2006 | Sugo et al. |
| 2007/0036785 A1 | 2/2007 | Kishimoto et al. |
| 2007/0041978 A1 | 2/2007 | Hattori et al. |
| 2007/0059312 A1 | 3/2007 | Baca et al. |
| 2007/0087005 A1 | 4/2007 | Lazar et al. |
| 2007/0087381 A1 | 4/2007 | Kojima |
| 2007/0172488 A1 | 7/2007 | Aburatani et al. |
| 2007/0224188 A1 | 7/2007 | Allan et al. |
| 2007/0185069 A1 | 8/2007 | Plum et al. |
| 2007/0190599 A1 | 8/2007 | Nakano et al. |
| 2007/0269444 A1 | 11/2007 | Kinoshita et al. |
| 2008/0008710 A1 | 1/2008 | Aburatani et al. |
| 2008/0051563 A1 | 2/2008 | Lazar et al. |
| 2008/0075712 A1 | 3/2008 | Hattori et al. |
| 2008/0124330 A1 | 5/2008 | Nakano et al. |
| 2008/0138827 A1 | 6/2008 | Watanabe et al. |
| 2008/0154025 A1 | 6/2008 | Lazar et al. |
| 2008/0161541 A1 | 7/2008 | Lazar et al. |
| 2008/0166756 A1 | 7/2008 | Tsuchiya et al. |
| 2008/0181890 A1 | 7/2008 | Lazar et al. |
| 2008/0267979 A1 | 10/2008 | Lazar et al. |
| 2009/0028868 A1 | 1/2009 | Fujiwara et al. |
| 2009/0060907 A1 | 3/2009 | Aburatani et al. |
| 2009/0117097 A1 | 5/2009 | Igawa et al. |
| 2009/0263392 A1 | 10/2009 | Igawa et al. |
| 2009/0324589 A1 | 12/2009 | Igawa et al. |
| 2010/0003254 A1 | 1/2010 | Hattori et al. |
| 2010/0015133 A1 | 1/2010 | Igawa et al. |
| 2010/0168430 A1 | 7/2010 | Ozawa et al. |
| 2010/0183595 A1 | 7/2010 | Aburatani et al. |
| 2010/0209432 A1 | 8/2010 | Terrette et al. |
| 2010/0239577 A1 | 9/2010 | Igawa et al. |
| 2010/0248359 A1 | 9/2010 | Nakano et al. |
| 2010/0256340 A1 | 10/2010 | Brinkmann et al. |
| 2010/0291072 A1 | 11/2010 | Lowman et al. |
| 2010/0298542 A1 | 11/2010 | Igawa et al. |
| 2010/0331527 A1 | 12/2010 | Davis et al. |
| 2011/0002922 A1 | 1/2011 | Aburatani et al. |
| 2011/0033452 A1 | 2/2011 | Nakano et al. |
| 2011/0076275 A1 | 3/2011 | Igawa et al. |
| 2011/0091907 A1 | 4/2011 | Kataoka et al. |
| 2011/0104157 A1 | 5/2011 | Kinoshita et al. |
| 2011/0236374 A1 | 9/2011 | Shitara et al. |
| 2011/0245473 A1 | 10/2011 | Igawa et al. |
| 2011/0287009 A1 | 11/2011 | Scheer et al. |
| 2012/0010387 A1 | 1/2012 | Niwa et al. |
| 2012/0237517 A1 | 9/2012 | Hattori et al. |
| 2013/0011866 A1 | 1/2013 | Igawa et al. |
| 2013/0039913 A1 | 2/2013 | Labrijn et al. |
| 2013/0115208 A1 | 5/2013 | Ho et al. |
| 2013/0131319 A1 | 5/2013 | Igawa |
| 2013/0195849 A1 | 8/2013 | Spreter Von Kreudenstein et al. |
| 2013/0295612 A1 | 11/2013 | Igawa et al. |
| 2014/0105889 A1 | 4/2014 | Igawa et al. |
| 2014/0112914 A1 | 4/2014 | Nezu et al. |
| 2014/0303356 A1 | 10/2014 | Gramer et al. |
| 2014/0363428 A1 | 12/2014 | Igawa et al. |
| 2014/0370020 A1 | 12/2014 | Kuramochi et al. |
| 2015/0050269 A1 | 2/2015 | Igawa et al. |
| 2015/0098941 A1 | 4/2015 | Lazar et al. |
| 2015/0210763 A1 | 7/2015 | Kuramochi et al. |
| 2015/0259417 A1 | 9/2015 | Nakano et al. |
| 2015/0284465 A1 | 10/2015 | Igawa et al. |
| 2015/0285806 A1 | 10/2015 | Ohtomo et al. |
| 2015/0315278 A1 | 11/2015 | Igawa et al. |
| 2015/0315280 A1 | 11/2015 | Hasegawa |
| 2016/0176954 A1 | 6/2016 | Ruike |
| 2016/0200807 A1 | 7/2016 | Ruike |
| 2016/0229908 A1 | 8/2016 | Igawa |
| 2016/0229915 A1 | 8/2016 | Igawa et al. |
| 2016/0244526 A1 | 8/2016 | Igawa |
| 2017/0002066 A1 | 1/2017 | Igawa |
| 2017/0002080 A1 | 1/2017 | Igawa |
| 2017/0022270 A1 | 1/2017 | Igawa et al. |
| 2017/0145111 A1 | 5/2017 | Hattori et al. |

FOREIGN PATENT DOCUMENTS

| | | |
|---|---|---|
| CA | 2451493 A1 | 1/2003 |
| CA | 2481658 A1 | 10/2003 |
| CA | 2801911 A1 | 3/2004 |
| CA | 2766627 A1 | 11/2004 |
| CA | 2700986 A1 | 4/2009 |
| CA | 2819530 A1 | 6/2012 |
| CA | 2497744 C | 3/2013 |
| CA | 2647846 C | 6/2016 |
| CN | 1277632 A | 12/2000 |
| CN | 1688692 A | 10/2005 |

(56) References Cited

FOREIGN PATENT DOCUMENTS

| | | |
|---|---|---|
| CN | 1842540 A | 10/2006 |
| CN | 101068836 A | 11/2007 |
| CN | 101377506 A | 3/2009 |
| CN | 102046200 A | 5/2011 |
| CN | 103833852 A | 6/2014 |
| EP | 0125023 A1 | 11/1984 |
| EP | 0329185 A2 | 8/1989 |
| EP | 0369566 A2 | 5/1990 |
| EP | 0592106 A1 | 4/1994 |
| EP | 0239400 B1 | 8/1994 |
| EP | 0628639 A1 | 12/1994 |
| EP | 0404097 B1 | 9/1996 |
| EP | 0783893 A1 | 7/1997 |
| EP | 0791359 A1 | 8/1997 |
| EP | 0811691 A1 | 12/1997 |
| EP | 1069185 A1 | 1/2001 |
| EP | 1176195 A1 | 1/2002 |
| EP | 1250023 A1 | 10/2002 |
| EP | 1331266 A1 | 7/2003 |
| EP | 1411118 A1 | 4/2004 |
| EP | 1462799 A1 | 9/2004 |
| EP | 1464702 A1 | 10/2004 |
| EP | 1498491 A1 | 1/2005 |
| EP | 1505148 A1 | 2/2005 |
| EP | 1541680 A1 | 6/2005 |
| EP | 0979281 B1 | 7/2005 |
| EP | 1605058 A1 | 12/2005 |
| EP | 1671645 A1 | 6/2006 |
| EP | 1674111 A1 | 6/2006 |
| EP | 1688488 A1 | 8/2006 |
| EP | 1693448 A1 | 8/2006 |
| EP | 1773391 A2 | 4/2007 |
| EP | 1780273 A1 | 5/2007 |
| EP | 1220923 B1 | 6/2007 |
| EP | 1795592 A2 | 6/2007 |
| EP | 1800693 A1 | 6/2007 |
| EP | 1561686 B1 | 7/2007 |
| EP | 1816140 A1 | 8/2007 |
| EP | 1829962 A1 | 9/2007 |
| EP | 1870458 A1 | 12/2007 |
| EP | 1870459 A1 | 12/2007 |
| EP | 1876236 A1 | 1/2008 |
| EP | 1900814 A1 | 3/2008 |
| EP | 1982718 A1 | 10/2008 |
| EP | 2006381 A1 | 12/2008 |
| EP | 2009101 A1 | 12/2008 |
| EP | 2107115 A1 | 10/2009 |
| EP | 2194066 A1 | 6/2010 |
| EP | 2202245 A1 | 6/2010 |
| EP | 1548442 B1 | 1/2011 |
| EP | 2409990 A1 | 1/2012 |
| EP | 2543727 A1 | 1/2013 |
| EP | 2647707 A1 | 10/2013 |
| EP | 2914634 | 5/2014 |
| EP | 1876236 B1 | 8/2014 |
| EP | 2905290 A1 | 8/2015 |
| EP | 3279216 A1 | 2/2018 |
| JP | H0159878 B2 | 12/1989 |
| JP | H0228200 A | 1/1990 |
| JP | H02145187 A | 6/1990 |
| JP | H04228089 A | 8/1992 |
| JP | H04336051 A | 11/1992 |
| JP | H05501543 A | 3/1993 |
| JP | H05184383 A | 7/1993 |
| JP | H05199894 A | 8/1993 |
| JP | H05203652 A | 8/1993 |
| JP | H05213775 A | 8/1993 |
| JP | H05304992 A | 11/1993 |
| JP | H0767688 A | 3/1995 |
| JP | H08500979 A | 2/1996 |
| JP | H10155494 A | 6/1998 |
| JP | H10165184 A | 6/1998 |
| JP | H102556223 A | 9/1998 |
| JP | H10511085 A | 10/1998 |
| JP | H11500915 A | 1/1999 |
| JP | H11500916 A | 1/1999 |
| JP | H1171288 A | 3/1999 |
| JP | H11118775 A | 4/1999 |
| JP | H11506310 A | 6/1999 |
| JP | H11355440 A | 12/1999 |
| JP | 2001108661 A | 4/2001 |
| JP | 2001523971 A | 11/2001 |
| JP | 2002042355 A | 2/2002 |
| JP | 2002048867 A | 2/2002 |
| JP | 2002518041 A | 6/2002 |
| JP | 2003509049 A | 3/2003 |
| JP | 2003149213 A | 5/2003 |
| JP | 2004053360 A | 2/2004 |
| JP | 2004503582 A | 2/2004 |
| JP | 20040086862 A | 3/2004 |
| JP | 2004511426 A | 4/2004 |
| JP | 3590070 B | 11/2004 |
| JP | 2004336051 A | 11/2004 |
| JP | 2005508920 A | 4/2005 |
| JP | 3697555 B | 9/2005 |
| JP | 2005274287 A | 10/2005 |
| JP | 200553541 A | 11/2005 |
| JP | 3775798 B | 5/2006 |
| JP | 2006523457 A | 10/2006 |
| JP | 2006523713 A | 10/2006 |
| JP | 2007093274 A | 4/2007 |
| JP | 2007238632 A | 9/2007 |
| JP | 2007256063 A | 10/2007 |
| JP | 2007300927 A | 11/2007 |
| JP | 2008501677 A | 1/2008 |
| JP | 2008504970 A | 2/2008 |
| JP | 2008098309 A | 4/2008 |
| JP | 4086811 B | 5/2008 |
| JP | 4228089 B2 | 2/2009 |
| JP | 2010522701 A | 7/2010 |
| JP | 2011508604 A | 3/2011 |
| JP | 2011118775 A | 6/2011 |
| JP | 2012082201 A | 4/2012 |
| JP | 2012522527 A | 9/2012 |
| JP | 2012531439 A | 12/2012 |
| JP | 5144499 B2 | 2/2013 |
| JP | 2013529084 A | 7/2013 |
| JP | 2013529190 A | 7/2013 |
| JP | 2013165716 A | 8/2013 |
| JP | 5334319 B2 | 11/2013 |
| JP | 5616428 B2 | 10/2014 |
| JP | 5681482 B2 | 3/2015 |
| JP | 2015511702 A | 4/2015 |
| JP | 2015130883 A | 7/2015 |
| JP | 5816170 B2 | 11/2015 |
| JP | 5882247 B2 | 3/2016 |
| JP | 5912436 B2 | 4/2016 |
| JP | 6022444 B | 11/2016 |
| JP | 6048972 B | 12/2016 |
| JP | 6157046 B2 | 7/2017 |
| KR | 20070034448 A | 3/2007 |
| KR | 20090107091 A | 10/2009 |
| KR | 20100056467 A | 5/2010 |
| KR | 20130130765 A | 12/2013 |
| RU | 2001124907 A | 6/2003 |
| RU | 2266298 C2 | 12/2005 |
| RU | 2005137578 A | 6/2007 |
| RU | 2337107 C2 | 10/2008 |
| TW | 201249872 A | 12/2012 |
| WO | WO-8304313 A1 | 12/1983 |
| WO | WO-9108770 A1 | 6/1991 |
| WO | WO-9201047 A1 | 1/1992 |
| WO | WO-9203918 A1 | 3/1992 |
| WO | WO-9219759 A1 | 11/1992 |
| WO | WO-9220791 A1 | 11/1992 |
| WO | WO-9306213 A1 | 4/1993 |
| WO | WO-9311161 A1 | 6/1993 |
| WO | WO-9311236 A1 | 6/1993 |
| WO | WO-9312227 A1 | 6/1993 |
| WO | WO-9319172 A1 | 9/1993 |
| WO | WO-9322332 A2 | 11/1993 |
| WO | WO-9402602 A1 | 2/1994 |
| WO | WO-9405690 A1 | 3/1994 |
| WO | WO-9501438 A1 | 1/1995 |

(56) References Cited

FOREIGN PATENT DOCUMENTS

| | | |
|---|---|---|
| WO | WO-9515388 A1 | 6/1995 |
| WO | WO-9515393 A1 | 6/1995 |
| WO | WO-9602576 A1 | 2/1996 |
| WO | WO-9607754 A1 | 3/1996 |
| WO | WO-9611020 A1 | 4/1996 |
| WO | WO-9612503 A1 | 5/1996 |
| WO | WO-9616673 A1 | 6/1996 |
| WO | WO-9626648 A1 | 9/1996 |
| WO | WO-9626964 A1 | 9/1996 |
| WO | WO-9627011 A1 | 9/1996 |
| WO | WO-9633735 A1 | 10/1996 |
| WO | WO-9634096 A1 | 10/1996 |
| WO | WO-9710354 A1 | 3/1997 |
| WO | WO-9803546 A1 | 1/1998 |
| WO | WO-9813388 A1 | 4/1998 |
| WO | WO-9823289 A1 | 6/1998 |
| WO | WO-9846777 A1 | 10/1998 |
| WO | WO-9850431 A2 | 11/1998 |
| WO | WO-9910494 A2 | 3/1999 |
| WO | WO-9918212 A1 | 4/1999 |
| WO | WO-9951743 A1 | 10/1999 |
| WO | WO-9954342 A1 | 10/1999 |
| WO | WO-9958572 A1 | 11/1999 |
| WO | WO-9967359 A2 | 12/1999 |
| WO | WO-0018806 A1 | 4/2000 |
| WO | WO-0023109 A1 | 4/2000 |
| WO | WO-0047228 A1 | 8/2000 |
| WO | WO-0061739 A1 | 10/2000 |
| WO | WO-0113940 A1 | 3/2001 |
| WO | WO-0119992 A2 | 3/2001 |
| WO | WO-0130854 A2 | 5/2001 |
| WO | WO-0182899 A2 | 11/2001 |
| WO | WO-0190192 A2 | 11/2001 |
| WO | WO-0205791 A2 | 1/2002 |
| WO | WO-0222739 A1 | 3/2002 |
| WO | WO-0231140 A1 | 4/2002 |
| WO | WO-0240545 A2 | 5/2002 |
| WO | WO-02079255 A1 | 10/2002 |
| WO | WO-03000883 A1 | 1/2003 |
| WO | WO-03010336 A2 | 2/2003 |
| WO | WO-03020949 A2 | 3/2003 |
| WO | WO-03028696 A2 | 4/2003 |
| WO | WO-03042231 A2 | 5/2003 |
| WO | WO-03042686 A1 | 5/2003 |
| WO | WO-03057881 A1 | 7/2003 |
| WO | WO-03074679 A2 | 9/2003 |
| WO | WO-03085119 A1 | 10/2003 |
| WO | WO-03087163 A1 | 10/2003 |
| WO | WO-03091424 A1 | 11/2003 |
| WO | WO-03100429 A2 | 12/2003 |
| WO | WO-2004003019 A2 | 1/2004 |
| WO | WO-2004009618 A2 | 1/2004 |
| WO | WO-2004016740 A2 | 2/2004 |
| WO | WO-2004018667 A1 | 3/2004 |
| WO | WO-2004022597 A1 | 3/2004 |
| WO | WO-2004022739 A1 | 3/2004 |
| WO | WO-2004022754 A1 | 3/2004 |
| WO | WO-2004023145 A1 | 3/2004 |
| WO | WO-2004029207 A2 | 4/2004 |
| WO | WO-2004035752 A2 | 4/2004 |
| WO | WO-2004038420 A1 | 5/2004 |
| WO | WO-2004065611 A1 | 8/2004 |
| WO | WO-2004068931 A2 | 8/2004 |
| WO | WO-2004090537 A2 | 10/2004 |
| WO | WO-2004093795 A2 | 11/2004 |
| WO | WO-2004096273 A1 | 11/2004 |
| WO | WO-2004097041 A2 | 11/2004 |
| WO | WO-2004099249 A2 | 11/2004 |
| WO | WO-2004111233 A1 | 12/2004 |
| WO | WO-2005023301 A1 | 3/2005 |
| WO | WO-2005025615 A2 | 3/2005 |
| WO | WO-2005035754 A1 | 4/2005 |
| WO | WO-2005035756 A1 | 4/2005 |
| WO | WO-2005047327 A2 | 5/2005 |
| WO | WO-2005059106 A2 | 6/2005 |
| WO | WO-2005062916 A2 | 7/2005 |
| WO | WO-2005067620 A2 | 7/2005 |
| WO | WO-2005106485 A1 | 11/2005 |
| WO | WO-2005112564 A2 | 12/2005 |
| WO | WO-2005117980 A1 | 12/2005 |
| WO | WO-2005123126 A2 | 12/2005 |
| WO | WO-2006004663 A2 | 1/2006 |
| WO | WO-2006006693 A1 | 1/2006 |
| WO | WO-2006022407 A1 | 3/2006 |
| WO | WO-2006030200 A1 | 3/2006 |
| WO | WO-2006030220 A1 | 3/2006 |
| WO | WO-2006046751 A1 | 5/2006 |
| WO | WO-2006050491 A2 | 5/2006 |
| WO | WO-2006066171 A1 | 6/2006 |
| WO | WO-2006067913 A1 | 6/2006 |
| WO | WO-2006074397 A2 | 7/2006 |
| WO | WO-2006096653 A2 | 9/2006 |
| WO | WO-2006106903 A1 | 10/2006 |
| WO | WO-2006106905 A1 | 10/2006 |
| WO | WO-2006109592 A1 | 10/2006 |
| WO | WO-2006121852 A2 | 11/2006 |
| WO | WO-2007005612 A2 | 1/2007 |
| WO | WO-2007018137 A1 | 2/2007 |
| WO | WO-2007030531 A2 | 3/2007 |
| WO | WO-2007047291 A2 | 4/2007 |
| WO | WO-2007053573 A2 | 5/2007 |
| WO | WO-2007059782 A1 | 5/2007 |
| WO | WO-2007060411 A1 | 5/2007 |
| WO | WO-2007081790 A2 | 7/2007 |
| WO | WO-2007091622 A2 | 8/2007 |
| WO | WO-2007099988 A1 | 9/2007 |
| WO | WO-2007114319 A1 | 10/2007 |
| WO | WO-2007114325 A1 | 10/2007 |
| WO | WO-2007137170 A2 | 11/2007 |
| WO | WO-2007145941 A2 | 12/2007 |
| WO | WO-2007147901 A1 | 12/2007 |
| WO | WO-2008043822 A2 | 4/2008 |
| WO | WO-2008090960 A | 7/2008 |
| WO | WO-2008118970 A2 | 10/2008 |
| WO | WO-2008119353 A1 | 10/2008 |
| WO | WO-2009012394 A1 | 1/2009 |
| WO | WO-2009041062 A1 | 4/2009 |
| WO | WO-2009041613 A1 | 4/2009 |
| WO | WO-2009041643 A1 | 4/2009 |
| WO | WO-2009053368 A1 | 4/2009 |
| WO | WO-2009089004 A1 | 7/2009 |
| WO | WO-2009116659 A1 | 9/2009 |
| WO | WO-2009120922 A2 | 10/2009 |
| WO | WO-2009122667 A1 | 10/2009 |
| WO | WO 2009134776 A2 | 11/2009 |
| WO | WO-2009149185 A2 | 12/2009 |
| WO | WO-2010034441 A1 | 4/2010 |
| WO | WO-2010102251 A2 | 9/2010 |
| WO | WO-2010107109 A1 | 9/2010 |
| WO | WO-2010115589 A1 | 10/2010 |
| WO | WO-2010129304 A2 | 11/2010 |
| WO | WO-2010151792 A1 | 12/2010 |
| WO | WO-2011108502 A1 | 9/2011 |
| WO | WO-2011111007 A2 | 9/2011 |
| WO | WO-2011131746 A2 | 10/2011 |
| WO | WO-2011133886 A2 | 10/2011 |
| WO | WO-2011143545 A1 | 11/2011 |
| WO | WO-2012020096 A1 | 2/2012 |
| WO | WO-2012073985 A1 | 6/2012 |
| WO | WO-2012145469 A1 | 10/2012 |
| WO | WO-2013060867 A2 | 5/2013 |
| WO | WO-2013118858 A1 | 8/2013 |
| WO | WO-2013127465 A1 | 9/2013 |
| WO | WO-2013157954 A1 | 10/2013 |
| WO | WO-2013181543 A1 | 12/2013 |
| WO | WO-2014028354 A1 | 2/2014 |
| WO | WO-2014051433 A1 | 4/2014 |
| WO | WO-2014054804 A1 | 4/2014 |
| WO | WO-2014067011 A1 | 5/2014 |
| WO | WO-2015046467 A1 | 4/2015 |
| WO | WO-2015046554 A1 | 4/2015 |
| WO | WO-2015156268 A1 | 10/2015 |
| WO | WO-2015174439 A1 | 11/2015 |

(56) References Cited

FOREIGN PATENT DOCUMENTS

| | | |
|---|---|---|
| WO | WO-2016047722 A1 | 3/2016 |
| WO | WO-2016159213 A1 | 10/2016 |
| WO | WO-2017159287 A1 | 9/2017 |

OTHER PUBLICATIONS

Bajaj, S.P., et al., "A Monoclonal Antibody to Factor IX That Inhibits the Factor VIII:Ca Potentiation of Factor X Activation," The Journal of Biological Chemistry 260(21):11574-11580, American Society for Biochemistry and Molecular Biology, United States (1985).

Bebbington, C.R., et al., "High-level Expression of a Recombinant Antibody From Myeloma Cells Using a Glutamine Synthetase Gene as an Amplifiable Selectable Marker," Bio/technology 10(2):169-175, Nature Pub. Co., United States (1992).

Bessos, H., et al., "The Characterization of a Panel of Monoclonal Antibodies to Human Coagulation Factor IX," Thrombosis Research 40(6):863-867, Pergamon Press, United States (1985).

Blazar, B.R., et al., "Infusion of Anti-B7.1 (CD80) and anti-B7.2 (CD86) Monoclonal Antibodies Inhibits Murine Graft-versus-host Disease Lethality in Part via Direct Effects on CD4+ and CD8+ T Cells," The Journal of Immunology 157(8):3250-3259, The American Association of Immunologists, United States (Oct. 1996).

Bolton-Maggs, P.H. and Pasi, K.J., "Haemophilias A and B," Lancet 361(9371):1801-1809, Elsevier, England (2003).

Borrebaeck, C.A. and Ohlin, M., "Antibody Evolution Beyond Nature," Nature Biotechnology 20(12)1189-1190, Nature America Publishing, United States (2002).

Bos, R. and Nieuvvenhuizen, W., "Enhanced Transfection of a Bacterial Plasmid Into Hybridoma Cells by Electroporation: Application for the Selection of Hybrid Hybridoma (Quadroma) Cell Lines," Hybridoma 11(1):41-51, Mary Ann Liebert, United States (1992).

Bowen, D.J., "Haemophilia A and Haemophilia B: Molecular Insights," Journal of Clinical Pathology: Molecular Pathology 55(1):1-18, BMJ Pub, England (2002).

Brandstetter, H., et al., "X-Ray Structure of Clotting Factor IXa: Active Site and Module Structure Related to Xase Activity and Hemophilia B," Proceedings of the National Academy of Sciences USA 92(21):9796-9800, The National Academy of Sciences, United States (Oct. 1995).

Brennan, M., et al., "Preparation of Bispecific Antibodies by Chemical Recombination of Monoclonal Immunoglobulin G1 Fragments," Science 229(4708):81-83, American Association for the Advancement of Science, United States (Jul. 1985).

Brinkman, H.J., et al., "Phospholipid-binding Domain of Factor VIII is Involved in Endothelial Cell-mediated Activation of Factor X by Factor IXa," Arteriosclerosis, Thrombosis, and Vascular Biology 22(3):511-516, Lippincott Williams & Wilkins, United States (2002).

Carter, P., "Bispecific Human IgG by Design," Journal of Immunological Methods 248(1-2):7-15, Elsevier, Netherlands (2001).

Chamow, S.M., et al., "A humanized, bispecific immunoadhesin-antibody that retargets CD3+ effectors to kill HIV-1-infected cells," The Journal of Immunology 153(9):4268-4280, The American Association of Immunologists, Inc., United States (1994).

Davie, E.W., et al., "The Coagulation Cascade: Initiation, Maintenance, and Regulation," Biochemistry 30(43):10363-10370, American Chemical Society, United States (1991).

De Pascalis, R., et al., "Grafting of 'Abbreviated' Complementarity-determining Regions Containing Specificity-determining Residues Essential for Ligand Contact to Engineer a Less Immunogenic Humanized Monoclonal Antibody," Journal of Immunology 169(6):3076-3084, The American Association of Immunologists, United States (Sep. 2002).

Deng, B., et al., "An Agonist Murine Monoclonal Antibody to the Human c-Mpl Receptor Stimulates Megakaryocytopoiesis," Blood 92(6):1981-1988, American Society of Hematology, United States (1998).

Ewert, S., et al., "Stability Improvement of Antibodies for Extracellular and Intracellular Applications: CDR Grafting to Stable Frameworks and Structure-based Framework Engineering," Methods 34(2):184-199, Academic Press, United States (Oct. 2004).

Fay, P.J., "Activation of Factor VIII and Mechanisms of Cofactor Action," Blood Reviews 18(1):1-15, Elsevier, England (2004).

Figini, M., et al., "In Vitro Assembly of Repertoires of Antibody Chains on the Surface of Phage by Renaturation," Journal of Molecular Biology 239(1):68-78, Elsevier, England (1994).

Francois, C., et al., "Construction of a Bispecific Antibody Reacting with the alpha- and beta-chains of the Human IL-2 Receptor. High Affinity Cross-linking and High Anti-proliferative Efficiency," Journal of Immunology 150(10):4610-4619, American Association of Immunologists, United States (1993).

Gonzales, N.R., et al., "Minimizing the Immunogenicity of Antibodies for Clinical Application," Tumor Biology 26(1):31-43, SAGE, United States (2005).

Grosse-Hovest, L., et al., "A Recombinant Bispecific Single-chain Antibody Induces Targeted, Supra-agonistic CD28-stimulation and Tumor Cell Killing," European Journal of Immunology 33(5):1334-1340, Wiley-VCH, Germany (2003).

Hammerling, U., et al., "Use of Hybrid Antibody with Anti-gamma-G and Anti-ferritin Specificities in Locating Cell Surface Antigens by Electron Microscopy," The Journal of Experimental Medicine 128(6):1461-1473, Rockefeller University Press, United States (1968).

Hoad, R.B. and Geczy, C.L., "Characterisation of Monoclonal Antibodies to Human Factor X/Xa. Initial Observations with a Quantitative ELISA Procedure," Journal of Immunological Methods 136(2):269-278, Elsevier, Netherlands (1991).

Holliger, P., et al., "Diabodies: Small Bivalent and Bispecific Antibody Fragments," Proceedings of the National Academy of Sciences USA 90(14):6444-6448, National Academy of Sciences, United States (Jul. 1993).

Hsia, C.C., et al., "Treatment of Acquired Factor X Inhibitor by Plasma Exchange With Concomitant Intravenous Immunoglobulin and Corticosteroids," American Journal of Hematology 83(4):318-320, Wiley-Blackwell, United States (2008).

Huse, W.D., et al., "Generation of a Large Combinatorial Library of the Immunoglobulin Repertoire in Phage Lambda," Science 246(4935):1275-1281, American Association for the Advancement of Science, United States (Dec. 1989).

Iwahashi, M.,et al., "CDR Substitutions of a Humanized Monoclonal Antibody (CC49): Contributions of Individual CDRs to Antigen Binding and Immunogenicity," Molecular Immunology 36(15-16):1079-1091, Pergamon Press, England (1999).

Janeway, C.A., Jr., et al., Immunobiology, Third Edition, Garland Press, pp. 3:1-3:11, 1997.

Jirholt, P., et al., "Exploiting Sequence Space: Shuffling In Vivo Formed Complementarity Determining Regions Into a Master Framework," Gene 215(2):471-476, Elsevier/North-Holland, Netherlands (1998).

Kang, A.S., et al., "Linkage of Recognition and Replication Functions by Assembling Combinatorial Antibody Fab Libraries along Phage Surfaces," Proceedings of National Academy of Science 88(10):4363-4366, National Academy of Science, United States (May 1991).

Karpovsky, B., et al., "Production of Target-specific Effector Cells Using Hetero-cross-linked Aggregates Containing Anti-target Cell and Anti-fc Gamma Receptor Antibodies," The Journal of Experimental Medicine 160(6):1686-1701, Rockefeller University Press, United States (1984).

Kim, S.H., et al., "Mammalian Type I Interferon Receptors Consists of Two Subunits: IFNaR1 and IFNaR2," Gene 196(1-2):279-286, Elsevier/North-Holland, Netherlands (1997).

Kroesen, B.J., et al., "Phase I Study of Intravenously Applied Bispecific Antibody in Renal Cell Cancer Patients Receiving Subcutaneous Interleukin 2," British Journal of Cancer 70(4):652-661, Nature Publishing Group, England (1994).

Kurokawa, T., et al., "Enhanced Fibrinolysis by a Bispecific Monoclonal Antibody Reactive to Fibrin and Tissue Plasminogen Activator," Nature Biotechnology 7:1163-1167 (1989).

(56) References Cited

OTHER PUBLICATIONS

Lapan, K.A. and Fay, P.J., "Interaction of the A1 Subunit of Factor VIIIa and the Serine Protease Domain of Factor X Identified by Zero-length Cross-linking," Thrombosis and Haemostasis 80(3):418-422, Schattauer, Germany (1998).

Le Doussal, J.M., et al., "Bispecific Monoclonal Antibody-mediated Targeting of an Indium-111-labeled DTPA Dimer to Primary Colorectal Tumors: Pharmacokinetics, Biodistribution, Scintigraphy and Immune Response," Journal of Nuclear Medicine 34(10):1662-1671, Society of Nuclear Medicine, United States (1993).

Lenting, P.J., et al., "The Life Cycle of Coagulation Factor VIII in view of its Structure and Function," Blood, 92(11):3983-3996, American Society of Hematology, United States (Dec. 1998).

Link, B.K. and Weiner, G.J., "Production and Characterization of a Bispecific IgG Capable of Inducing T-cell-mediated Lysis of Malignant B Cells," Blood 81(12):3343-3349, American Society of Hematology, United States (1993).

Lofqvist, T., et al., "Haemophilia Prophylaxis in Young Patients—a Long-Term Follow-up," Journal of Internal Medicine 241(5):395-400, Blackwell Scientific Ltd., England (May 1997).

Lu, D., et al., "Di-Diabody: a Novel Tetravalent Bispecific Antibody Molecule by Design," Journal of Immunological Methods 279(1-2):219-232, Elsevier, Netherlands (2003).

Lu, D., et al., "Fab-scFv Fusion Protein: an Efficient Approach to Production of Bispecific Antibody Fragments," Journal of Immunological Methods 267(2):213-226, Elsevier, Netherlands (2002).

Massino, Y.S., et al., "Quantitative Analysis of the Products of IgG Chain Recombination in Hybrid Hybridomas Based on Affinity Chromatography and Radioimmunoassay," Journal of Immunological Methods 201(1):57-66, Elsevier, Netherlands (1997).

McCafferty, J., et al., "Phage Antibodies: Filamentous Phage Displaying Antibody Variable Domains," Nature 348(6301):552-554, Nature Publishing Group, London (Dec. 1990).

Menegatti, M., et al., "Factor X Deficiency," Seminars in Thrombosis and Hemostasis 35(4):407-415, Thieme, United States (Jun. 2009).

Mertens, K., et al., "Factor VIII-Factor IX Interactions: Molecular Sites Involved in Enzyme-Cofactor Complex Assembly," Thrombosis and Haemostasis 82(2):209-217, Stuttgart, Schattauer, Germany (1999).

Milstein, C. and Cuello, A.C., "Hybrid Hybridomas and their Use in Immunohistochemistry," Nature 305(5934):537-540, Nature Publishing Group, England (Oct. 1983).

Mohan, C., "Calbiochem Buffers: A guide for the preparation and use of buffers in biological systems," Copyright 2003 EMD Biosciences, Inc.,an Affliate of Merck KGaA, Darmastadt, Germany, 37pages.

Nilsson, I.M., et al., "Induction of Split Tolerance and Clinical Cure in High-responding Hemophiliacs with Factor IX Antibodies," Proceedings of the National Academy of Sciences of the United States of America 83(23):9169-9173, National Academy of Sciences, United States (1986).

Nilsson, I.M., et al., "Twenty-five Years' Experience of Prophylactic Treatment in Severe Haemophilia A and B," Journal of Internal Medicine 232(1):25-32, Blackwell Scientific Publications, England (Jul. 1992).

Nitta, T., et al., "Preliminary Trial of Specific Targeting Therapy Against Malignant Glioma," Lancet 335(8686):368-371, Elsevier, England (1990).

Okubo, Y., et al., "The Production and Characterization of Four Monoclonal Antibodies to Human Factor X," Journal of Nara Medical Association 38(1):20-28, Nara Medical Association and University, Japan (1978).

Berzofsky, J.A. and Berkower, I.J., "Immunogenicity and Antigen Structure," in Fundamental Immunology, Third Edition, pp. 242, Raven Press, United States (1993).

Piper, J.M., et al., "Interferon Therapy in Primary Care," Primary Care Update for Ob/Gyns 8(4):163-169, Elsevier, United States (2001).

Portolano, S., et al., "Lack of Promiscuity in Autoantigen-Specific H and L Chain Combinations as Revealed by Human H and L Chain 'Roulette'," The Journal of Immunology 150(3):880-887, The American Association of Immunologists, United States (1993).

Price, G.C., et al., "Tissue Factor and Tissue Factor Pathway Inhibitor," Anaesthesia 59(5):483-492, Wiley-Blackwell, England (2004).

Rudikoff, S., et al., "Single Amino Acid Substitution Altering Antigen-binding Specificity," Proceedings of the National Academy of Sciences USA 79(6):1979-1983, The National Academy of Sciences, United States (Mar. 1982).

Ruef, J., et al., "A Bispecific Antifibrin-antiplatelet Urokinase Conjugate (BAAUC) Induces Enhanced Clot Lysis and Inhibits Platelet Aggregation," Thrombosis and Haemostasis 82(1):109-114, Schattauer, Germany (1999).

Sato, Y., et al., "Properties of Two VEGF Receptors, Flt-1 and KDR, in Signal Transduction," Annals of the New York Academy of Sciences 902:201-207, Blackwell, United States (2000).

Schmidt, A.E. and Bajaj, S.P., "Structure-function Relationships in Factor IX and Factor IXa," Trends in Cardiovascular Medicine 13(1):39-45, Elsevier Science, United States (Jan. 2003).

Segal, D.M., et al., "Introduction: Bispecific Antibodies," Journal of Immunological Methods 248(1-2):1-6, Elsevier, Netherlands (2001).

Shalaby, M.R., et al., "Development of Humanized Bispecific Antibodies Reactive with Cytotoxic Lymphocytes and Tumor Cells Overexpressing the HER2 Protooncogene," The Journal of Experimental Medicine 175(1):217-225, The Rockefeller University Press, United States (Jan. 1992).

Shima, M., et al., "Factor VIII Mimetic Antibody: (2) In Vitro Assessment of Cofactor Activity in Hemophilia A" Rinsho Ketsueki 46(8):777(#WS-36-5) (2005).

Soeda, T., et al., "Factor VIII Mimetic Antibody: (1) Establishment of Anti-FIXa/FX Bispecific Antibodies," Rinsho Ketsueki 46(8):728(#PL-2-4) (2005).

Soeda, T., et al., "FVIII-Mimetic Action of Anti-FIXa/Anti-FX Bispecific Antibodies Produced by the Phage Library Method," Japanese Journal of Thrombosis and Hemostasis 16(5):526(#O-24) (2005).

Stickney, D.R., et al., "Bifunctional Antibody: A Binary Radiopharmaceutical Delivery System for Imaging Colorectal Carcinoma," Cancer Research 51(24):6650-6655, American Association for Cancer Research, United States (1991).

Suresh M.R. et al., "Advantages of bispecific hybridomas in one-step immunocytochemistry and immunoassays," Neurobiology, Proceedings of the National Academy of Sciences of the United States of America 83(20):7989-7993, The National Academy of Science, United States (1986).

Suresh, M.R., et al., "Bispecific Monoclonal Antibodies from Hybrid Hybridomas," Methods in Enzymology 121:210-228, Academic Press Inc., United States (1986).

Taki Medical Bulletin. 1994 #193 The Journal of Japanese Society on Thrombosis and Hemostasis. Feb. 2, 2002, 13(1):109-113.

Tamura, M., et al., "Structural Correlates of an Anticarcinoma Antibody: Identification of Specificity-determining Residues (SDRs) and Development of a Minimally Immunogenic Antibody Variant by Retention of SDRs Only," The Journal of Immunology 164(3):1432-1441, American Association of Immunologists, United States (Feb. 2000).

Vaughan, T.J., et al., "Human Antibodies with Sub-nanomolar Affinities Isolated from a Large non-Immunized Phage Display Library," Nature Biotechnology 14(3):309-314, Nature Publishing Co., United States (1996).

Weiner, G.J., et al., "A Human Tumor Xenograft Model of Therapy With a Bispecific Monoclonal Antibody Targeting c-erbB-2 and CD16," Cancer Research 53(1):94-100, American Association for Cancer Research, United States (1993).

Weiner, G.J., et al., "The Role of T Cell Activation in Anti-CD3 x Antitumor Bispecific Antibody Therapy," Journal of Immunology 152(5):2385-2392, American Association of Immunologists, United States (1994).

(56) References Cited

OTHER PUBLICATIONS

Xiang, J., et al., "Production of Murine V-human Cκ1 Chimeric Anti-TAG72 Antibody using V Region cDNA Amplified by PCR," Molecular Immunology 27(8):809-817, Pergamon Press, England (1990).

Amersham Biosciences, "Protein Purification Handbook," Edition AC, 98 pages (2001).

Chugai Seiyaku Kabushiki Kaisha's letter dated Jun. 12, 2013, regarding oral proceedings scheduled on Jun. 26, 2013, in Application Serial No. EP06730769.4 (Annex A submitted with patentee's letter dated Jun. 12, 2013), 17 pages.

Hattori, et al., Co-pending U.S. Appl. No. 14/921,590, filed Oct. 23, 2015.

Hattori, et al., Co-pending U.S. Appl. No. 15/172,727, filed Jun. 6, 2016.

Hattori, et al., Co-pending U.S. Appl. No. 15/402,580, filed Jan. 10, 2017.

Novaro, V. and Radisky D., "Meeting Report, 93rd Annual Meeting of the American Association for Cancer Research, San Francisco, CA, Apr. 6-10, 2002" Breast Cancer Research 43(4):165-168, BioMed Central Ltd., England (Mar. 2002).

Abhinandan, K.R., et al., "Analyzing the "Degree of Humanness" of Antibody Sequences," Journal of Molecular Biology 369(3):852-862, Elsevier, England (2007).

Lage, H., et al., "Glypican-3 Contributes to a Mitoxantrone-Resistant Phenotype in Gastric Carcinoma Cells," Abstract, Proceedings of the American Association for Cancer Research, 42:279, printed from Database Biosis Online! Biosciences Information Service, Philadelphia, PA, U.S., XP001203974 (Mar. 2001).

Adams, C.W., et al., "Humanization of a Recombinant Monoclonal Antibody to Produce a Therapeutic Her Dimerization Inhibitor, Pertuzumab," Cancer Immunology, Immunotherapy 55(6):717-727, Springer International, Germany (2006).

Amit, A.G., et al., "Three-Dimensional Structure of an Antigen-Antibody Complex at 2.8 A Resolution," Science 233(4765):747-753, American Association for the Advancement of Science, United States (1986).

Arii, S., et al., "Characteristics of Recurrent Hepatocellular Carcinoma in Japan and Our Surgical Experience," Journal of Hepato-biliary-pancreatic Surgery 8(5):397-403, Springer International, Japan (2001).

Baneyx, F., "Recombinant Protein Expression in *Escherichia coli*," Current Opinion in Biotechnology 10(5):411-421, Current Biology, England (1999).

Bendayan, M., "Possibilities of False Immunocytochemical Results Generated by the Use of Monoclonal Antibodies: The Example of the Anti-proinsulin Antibody," The Journal of Histochemistry and Cytochemistry 43(9):881-886, Williams & Wilkins Co., United States (1995).

Bendig, M.M., "Humanization of Rodent Monoclonal Antibodies by CDR Grafting," Methods: A Companion to Methods in Enzymology 8(2):83-93, Academic Press, United States (1995).

Bigge, J.C., et al., "Nonselective and Efficient Fluorescent Labeling of Glycans Using 2-Amino Benzamide and Anthranilic Acid," Analytical Biochemistry 230(2):229-238, Academic Press, United States (1995).

Binz, H.K., et al., "Engineering Novel Binding Proteins from Nonimmunoglobulin Domains," Nature Biotechnology 23(10):1257-1268, Nature America Publishing, United States (Oct. 2005).

Blackhall, F.H., et al., "Heparan Sulfate Proteoglycans and Cancer," British Journal of Cancer 85(8):1094-1098, Nature Publishing Group, England (2001).

Bodey, B., et al., "Genetically Engineered Monoclonal Antibodies for Direct Anti-neoplastic Treatment and Cancer Cell Specific Delivery of Chemotherapeutic Agents," Current Pharmaceutical Design 6(3):261-276, Bentham Science Publishers, Netherlands (2000).

Boer, P.H., et al., "Polymorphisms in the Coding and Noncoding Regions of Murine Pgk-1 Alleles," Biochemical Genetics 28(5-6):299-308, Kluwer Academic/Plenum Publishers, New York (1990).

Bosch, F.X., et al., "Primary Liver Cancer: Worldwide Incidence and Trends," Gastroenterology 127(5 Suppl 1):S5-S16, W.B. Saunders, United States (2004).

Bost, K.L. and Pascual, D.W., "Antibodies Against a Peptide Sequence Within the HIV Envelope Protein Crossreacts With Human Interleukin-2," Immunological Investigations 17(6-7):577-586, Informa Healthcare, England (1988).

Brand, F.X., et al., "Prospect for Anti-HER2 Receptor Therapy in Breast Cancer," Anticancer Research 26(1B):463-470, International Institute of Anticancer Research, Greece (2006).

Brorson, K., et al., "Mutational Analysis of Avidity and Fine Specificity of Anti-Levan Antibodies," Journal of Immunology 163(12):6694-6701, American Association of Immunologists, United States (1999).

Brummell, D.A., et al., "Probing the Combining Site of an Anti-Carbohydrate Antibody by Saturation-Mutagenesis: Role of the Heavy-Chain CDR3 Residues," Biochemistry 32(4):1180-1187, American Chemical Society, United States (1993).

Budhu, A.S., et al., "The Molecular Signature of Metastases of Human Hepatocellular Carcinoma," Oncology 69(1):23-27, Karger, Switzerland (2005).

Burgess, W.H., et al., "Possible Dissociation of the Heparin-binding and Mitogenic Activities of Heparin-binding (Acidic Fibroblast) Growth Factor-1 from Its Receptor-binding Activities by Site-directed Mutagenesis of a Single Lysine Residue," The Journal of Cell Biology 111(5Pt1):2129-2138, The Rockefeller University Press, United States (Nov. 1990).

Burks, E.A., et al., "In vitro Scanning Saturation Mutagenesis of an Antibody Binding Pocket," Proceedings of the National Academy of Sciences USA 94(2):412-417, Plenum Publishing Corporation, United States (1997).

Buskens, C., et al., "Adenocarcinomas of the Gastro-Esophageal Junction: A Comparative Study of the Gastric Cardia and the Esophagus with Respect to Cyclooxygenase-2 Expression," Digestive Disease Week Abstracts and Itinerary Planner, 2003, abstract No. 850.

Caldas, C., et al., "Humanization of the Anti-Cd18 Antibody 6.7: An Unexpected Effect of a Framework Residue in Binding to Antigen," Molecular Immunology 39(15):941-952, Pergamon Press, England (May 2003).

Capurro, M., et al., "Glypican-3: a Novel Serum and Histochemical Marker for Hepatocellular Carcinoma," Gastroenterology 125(1):89-97, W.B. Saunders, United States (2003).

Carter, P., et al., "Humanization of an Anti-p185HER2 Antibody for Human Cancer Therapy," Proceedings of the National Academy of Sciences USA 89(10):4285-4289, National Academy of Sciences, United States (May 1992).

Carter, P., et al., "Identification and Validation of Cell Surface Antigens for Antibody Targeting in Oncology," Endocrine-Related Cancer 11(4):659-687, BioScientifica, England (2004).

Carter, P., "Improving the efficacy of antibody-based cancer therapies," Nature Reviews Cancer 1(2):118-129, Nature Publishing Group, United States (2001).

Casset, F., et al., "A Peptide Mimetic of an Anti-CD4 Monoclonal Antibody by Rational Design," Biochemical and Biophysical Research Communications 307(1):198-205, Academic Press, United States (Jul. 2003).

Igawa, et al., Co-pending U.S. Appl. No. 15/495,026, filed Apr. 24, 2017.

Cellquest Software User's Guide (BD Biosciences) (1994) pp. 173-174.

Chen, G., et al., "Discordant Protein and mRNA Expression in Lung Adenocarcinomas," Molecular & Cellular Proteomics 1(4):304-313, American Society for Biochemistry and Molecular Biology, United States (2002).

Chen, Y., et al., "Selection and Analysis of an Optimized Anti-VEGF Antibody: Crystal Structure of an Affinity-matured Fab in Complex with Antigen," Journal of Molecular Biology 293(4):865-881, Academic Press, England (Nov. 1999).

(56) References Cited

OTHER PUBLICATIONS

Chia, W.K., et al., "Phase II Trial of Gemcitabine in Combination with Cisplatin in Inoperable or Advanced Hepatocellular Carcinoma," Annals of the Academy Medicine, Singapore 37(7):554-558, Academy of Medicine, Singapore (2008).
Chien, N.C., et al., "Significant Structural and Functional Change of an Antigen-Binding Site by a Distant Amino Acid Substitution: Proposal of a Structural Mechanism," Proceedings of the National Academy of Sciences USA 86(14):5532-5536, National Academy of Sciences, United States (1989).
Zhou, X., et al., "Expression and Significance of MXR7 mRNA in human hepatocellular carcinoma," Chinese Journal of Surgery, 37(3)171-173 (Mar. 1999).
Chothia, C. and Lesk, A.M., "Canonical Structures for the Hypervariable Regions of Immunoglobulins," Journal of Molecular Biology 196(4):901-917, Elsevier Science, United States (Aug. 1987).
Chothia, C., et al., "Conformations of Immunoglobulin Hypervariable Regions," Nature 342(6252):877-883, Nature Publishing Group, England (Dec. 1989).
Chung, M.C.M., et al., "Proteomics of Hepatocellular Carcinoma: Present Status and Future Prospects," Proteomics: Biomedical and Pharmaceutical Applications, pp. 163-181 (2004).
Clackson, T., et al., "Making Antibody Fragments using Phage Display Libraries," Nature 352(6336):624-628, Nature Publishing Group, England (Aug. 1991).
Coligan, A.J., et al., "Current Protocols in Immunology," Immunologic studies in humans. Chapter 7:John Wiley & Sons, Inc. (1993).
Colman, P.M., "Effects of Amino Acid Sequence Changes on Antibody-antigen Interactions," Research in Immunology 145(1):33-36, Elsevier, France (Jan. 1994).
Couto, J.R., et al., "Anti-BA46 Monoclonal Antibody Mc3: Humanization Using a Novel Positional Consensus and In Vivo and In Vitro Characterization," Cancer Research 55(8):1717-1722, American Association for Cancer Research, United States (1995).
Cox, K.M., et al., "Glycan Optimization of a Human Monoclonal Antibody in the Aquatic Plant Lemna Minor," Nature Biotechnology 24(12):1591-1597, Nature America Publishing, United States (2006).
Cragg, M.S., et al., "Signaling Antibodies in Cancer Therapy," Current Opinion in Immunology 11(5):541-547, Elsevier, England (1999).
Current Protocols in Molecular Biology, Chapter 11, "Immunology," edited by Ausubel et al. (1987) John Wiley & Sons, sections 11.4-11.11.
Current Protocols in Molecular Biology, Chapter 9, "Introduction of DNA into Mammalian Cells," edited by Ausubel et al. (1987) John Wiley & Sons, sections 9.1-9.9.
Curti, B.D., "Physical Barriers to Drug Delivery in Tumors," Critical Reviews in Oncology/Hematology 14(1):29-39, Elsevier Scientific Publishers, Netherlands (Feb. 1993).
Dall'Acqua, W.F., et al., "Antibody Humanization by Framework Shuffling," Methods 36(1):43-60, Academic Press, United States (2005).
Santa Cruz Biotechnology, Inc. Datasheet from antibody glypican-3 (H-162): sc-11395 (Online), Aug. 24, 2001 (Aug. 24, 2001 ), XP 002434126, Retrieved from the Internet: URL: http://datasheets.scbt.com/sc-11395.pdf.
Decat, B. and David, G., "Developmental Roles of the Glypicans," Seminars in Cell & Developmental Biology 12(2):117-125, Academic Press, England (2001).
Dennis, C., "Cancer: Off by a Whisker," Nature 442(7104):739-741, Nature Publishing Group, England (Aug. 2006).
Dermer, G.B., "Another Anniversary for the War on Cancer," Biotechnology 12:320, Nature Publishing Co., United States (1994).
Dillman, R.O., "Monoclonal Antibodies for Treating Cancer," Annals of Internal Medicine 111(7):592-603, American College of Physicians-American Society of Internal Medicine, United States (Oct. 1989).

Dillman, R.O., "Monoclonal Antibodies in the Treatment of Malignancy: Basic Concepts and Recent Developments," Cancer Investigation 19(8):833-841, Taylor & Francis, England (2001).
Dipiro et al., "Lesson 2: Basic Pharmacokinetics," Concept in Clinical Pharmacokinetics, Fifth Edition, American Society of Health-System Pharmacists, pp. 19-28 (2010).
Drexler, H.G., "Recent Results on the Biology of Hodgkin and Reed-Sternberg Cells. II. Continuous Cell Lines," Leukemia & Lymphoma 9(1-2):1-25, Informa Healthcare, England (1993).
Dufner, P., et al, "Harnessing Phage and Ribosome Display for Antibody Optimisation," Trends in Biotechnology 24(11):523-529, Elsevier Science, England (2006).
Ebert, K.M., et al., "Induction of Human Tissue Plasminogen Activator in the Mammary Gland of Transgenic Goats," Bio/Technology 12(7):699-702, Nature Pub. Co., United States (1994).
Eccles, S.A., "Monoclonal Antibodies Targeting Cancer: 'Magic Bullets' or Just the Trigger?," Breast Cancer Research 3(2):86-90, BioMed Central Ltd, England (2001).
Embleton, M.J., "Monoclonal Antibodies to Osteogenic Sarcoma Antigens," Immunology Series, 23:181-207 (1984).
Endo, M., "A Novel Molecular Targeted Therapy, Humanized Anti-glypican 3 Antibody (Gc33), for the Treatment of Unresectable Hepatocellular Cancer," Medical Science Digest 39(9):440-443 (2013).
Ferrara, C., et al., "Modulation of Therapeutic Antibody Effector Functions by Glycosylation Engineering: Influence of Golgi Enzyme Localization Domain and Co-Expression of Heterologous Beta1, 4-N-Acetylglucosaminyltransferase III and Golgi Alpha-Mannosidase II," Biotechnology and Bioengineering 93(5):851-861, Wiley, New York (2006).
Filmus, J., "Glypicans in Growth Control and Cancer," Glycobiology 11(3):19R-23R, Oxford University Press, England (2001).
Freshney, R.I., "Culture of Animal Cells," A Manual of Basic Technique, p. 4, Alan R. Liss, Inc., United States (1983).
"Fundamental Study Pertaining to ADCC with Monoclonal Antibody to Tumor-associated Antigen," Medical care and New medicines, 19(3):473-478 (1982) (with partial English translation).
Furuse, J., et al., "Phase I Study of Sorafenib in Japanese Patients with Hepatocellular Carcinoma," Cancer Science 99(1):159-165, Blackwell Publishing, England (2007).
Galfre, G. and Milstein, C., "Preparation of Monoclonal Antibodies: Strategies and Procedures," Methods in Enzymology 73(Pt B):3-46, Academic Press, United States (1981).
Gandy, A., "Sorafenib New First-Line Option for Advanced Liver Cancer," 2007, accessed at www.medscape.com/viewarticle/558023, accessed on Jun. 11, 2007.
Gangopadhyay, A., et al., "Modification of Antibody Isoelectric Point Affects Biodistribution of 111-Indium-Labeled Antibody," Nuclear Medicine and Biology 23(3):257-261, Elsevier, United States (1996).
Gao, Y.L., et al., "Inhibition of Human Glioma Cell Growth by a Soluble Recombinant Human CD40 Ligand," Chinese Journal of Cancer 21(10):1112-1115, English Abstract, Zhongshan da xue zhong liu fang zhi zhong xin, China (2002).
Ghetie, V. and Ward, E.S., "FcRn: the MHC Class I-Related Receptor that is More Than an IgG Transporter," Immunology Today 18(12):592-598, Elsevier Science Publishers, England (1997).
Ghetie, V., et al., "Increasing the Serum Persistence of an IgG Fragment by Random Mutagenesis," Nature Biotechnology 15(7):637-640, Nature America Publishing, United States (Jul. 1997).
Ghetie, V., et al., "Multiple Roles for the Major Histocompatibility Complex Class I-related Receptor FcRn," Annual Review of Immunology 18:739-766, Annual Review, United States (Apr. 2000).
Ghirlando, R., et al., "Glycosylation of Human IgG-Fc: Influences on Structure Revealed by Differential Scanning Micro-Calorimetry," Immunology Letters 68(1):47-52, Elsevier/North-Holland Biomedical Press, Netherlands (1999).
Gobburu, J.V., et al., "Pharmacokinetics/Dynamics of 5c8, A Monoclonal Antibody to CD154 (CD40 Ligand) Suppression of an Immune Response in Monkeys," Journal of Pharmacology and

(56) References Cited

OTHER PUBLICATIONS

Experimental Therapeutics 286(2):925-930, American Society for Pharmacology and Experimental Therapeutics, United States (1998).
Goding, J.W., "Production of Monoclonal Antibodies," in Monoclonal Antibodies: Principles and Practice, 2nd ed., pp. 59-103, Academic Press Inc., London (1986).
Goldenberg, D., et al., "Analysis of Differentially Expressed Genes in Hepatocellular Carcinoma Using cDNA Arrays," Molecular Carcinogenesis 33(2):113-124, Wiley-Liss, United States (2002).
Goldenberg, D.M and Sharkey, R.M., "Novel Radiolabeled Antibody Conjugates," Oncogene 26(25):3734-3744, Nature Publishing Group, England (2007).
Gonzalez, A.D., et al., "OCI-5/GPC3, A Glypican Encoded by a Gene that is Mutated in the Simpson-golabi-behmel Overgrowth Syndrome, Induces Apoptosis in a Cell Line-specific Manner," The Journal of Cell Biology 141(6)1407-1414, Rockefeller University Press, United States (1998).
Graves, S.S., et al., "Molecular Modeling and Preclinical Evaluation of the Humanized NR-LU-13 Antibody," Clinical Cancer Research 5(4):899-908, The Association, United States (1999).
Green, D.R., et al., "Activation-induced Cell Death in T Cells," Immunological Reviews 193:70-81, Blackwell, England (2003).
Greenspan, N.S. and Di Cera, E., "Defining Epitopes: It's not as Easy as it Seems," Nature Biotechnology 17(10):936-937, Nature Publishing Group, United States (1999).
Griffiths, A.D., et al., "Isolation of High Affinity Human Antibodies Directly From Large Synthetic Repertoires," The EMBO Journal 13(14):3245-3260, (1994).
Grillo-Lopez, A.J., et al., "Rituximab: The First Monoclonal Antibody Approved for the Treatment of Lymphoma", Current Pharmaceutical Biotechnology 1(1):1-9, Bentham Science Publishers, Netherlands (2000).
Grozdanov, P.N., et al., "The Oncofetal Protein Glypican-3 is a Novel Marker of Hepatic Progenitor/Oval Cells," Laboratory Investigation 86(12):1272-1284, Nature Pub. Group, United States (2006).
Gura, T., "Systems for Identifying New Drugs are often Faulty," Science 278(5340):1041-1042, American Association for the Advancement of Science, United States (Nov. 1997).
Harlow, E. and Lane, D. "Antibodies, a Laboratory Manual," Cold Spring Harbor Laboratory Press, p. 141-243 (1988).
Harlow, E. and Lane, D., "Cell Staining," Cold Spring Harbor Laboratory 359-420 (1988).
Hashiguchi, A., et al., "Using Immunofluorescent Digital Slide Technology to Quantify Protein Expression in Archival Paraffin-embedded Tissue Sections," Pathology International 60(11):720-725, Japanese Society of Pathology, Australia (2010).
He, X.Y., et al., "Humanization and Pharmacokinetics of a Monoclonal Antibody with Specificity for both E- and P-Selectin," Journal of Immunology 160(2):1029-1035, American Association of Immunologists, United States (1998).
Hinton, P.R., et al., "An Engineered Human IgG1 Antibody with Longer Serum Half-Life," Journal of Immunology 176(1):346-356, American Association of Immunologists, United States (2006).
Hinton, P.R., et al., "Engineered Human IgG Antibodies With Longer Serum Half-lives in Primates," The Journal of Biological Chemistry 279(8):6213-6216, American Society for Biochemistry and Molecular Biology, United States (2004).
Hipp, M.M., et al., "Sorafenib, but not Sunitinib, Affects Function of Dendritic Cells and Induction of Primary Immune Responses," Blood 111(12):5610-5620, American Society of Hematology, United States (Jun. 2008).
Hippo, Y., et al., "Identification of Soluble NH2-terminal Fragment of Glypican-3 as a Serological Marker for Early-stage Hepatocellular Carcinoma," Cancer Research 64(7):2418-2423, American Association for Cancer Research, United States (2004).
Ho, M. and Kim, H., "Glypican-3: A New Target for Cancer Immunotherapy," European Journal of Cancer 47(3):333-338, Elsevier Science Ltd., England (2011).

Holm, P., et al., "Functional Mapping and Single Chain Construction of the Anti-cytokeratin 8 Monoclonal Antibody TS1," Molecular Immunology 44(6):1075-1084, Pergamon Press, England (Feb. 2007).
Honda, M., et al., "Hepatocarcinogenesis and Altered Gene Expression," Liver, Gallbladder and Pancreas, 48(4):447-453 (2004) with English Translation.
Honda, M., et al., "cDNA Microarray Gene Expression Analysis of Chronic Hepatitis and Hepatocellular Carcinoma" Molecular Medicine 39(8):938-946 (2002) with English Translation.
Hopfner, M., et al., "Growth Factor Receptors and Related Signaling Pathways as Targets for Novel Treatment Strategies of Hepatocellular Cancer," World Journal of Gastroenterology 14(1):1-14, Baishideng Publishing Group, United States (2008).
Houdebine, L.M., "Production of Pharmaceutical Proteins from Transgenic Animals," Journal of Biotechnology 34(3):269-287, Elsevier Science, Netherlands (1994).
Hsu, H.C., et al., "Cloning and Expression of a Developmentally Regulated Transcript MXR7 in Hepatocellular Carcinoma: Biological Significance and Temporospatial Distribution," Cancer Research 57(22):5179-5184, American Association for Cancer Research, United States (1997).
Hsu, T.C., "Karyology of Cells in Culture," in Tissue Culture Methods and Applications, Kruse and Patterson, Eds, Academic Press, NY, abstract (1973).
Huber, R.M., "Structure and Function of the Human Glypican 3 Gene," PhD Dissertation, Washington University, (Dec. 1998).
Huynh, H., et al., "Bevacizumab and Rapamycin Induce Growth Suppression in Mouse Models of Hepatocellular Carcinoma," Journal of Hepatology 49(1):52-60, Munksgaard International Publishers, Netherlands (2008).
Hwang, W.Y., et al., "Use of Human Germline Genes in a CDR Homology-Based Approach to Antibody Humanization," Methods 36(1):35-42, Academic Press, United States (2005).
Iizuka, N., et al., "DNA Microarray Study of Hepatocellular Carcinoma," The Medical Frontline 59(6):135-143 (2004) (with English Translation).
Ikeda, M., et al., "Japanese Phase I Study of GC33, a Humanized Antibody Against Glypican-3 for Advanced Hepatocellular Carcinoma," Cancer Science 105(4):455-462, Japanese Cancer Association, England (2014).
Ikeda, M., et al., "A Phase II Trial of Continuous Infusion of 5-Fluorouracil, Mitoxantrone, and Cisplatin for Metastatic Hepatocellular Carcinoma," Cancer 103(4):756-762, Wiley, United States (2005).
Ishiguro, T., et al., "Anti-Giypican 3 Antibody as a Potential Antitumor Agent for Human Liver Cancer," Cancer Research 68(23):9832-9838, American Association for Cancer Research, United States (2008).
Jain, R.K., "Barriers to Drug Delivery in Solid Tumors," Scientific American 271(1):58-65, Scientific American, Inc., United States (Jul. 1994).
Janeway, C.A., Jr. and Travers, P.,"The Immune System in Health and Disease", 8:22-23, Immunobiology, Garland Publishing, Inc. New York, United States (1994).
Janeway, C.A., Jr., et al., "Structure of the Antibody Molecule and Immunoglobulin Genes" 3:1-11, Immunobiology, 3rd Edition, Garland Science, New York, United States (2001).
Jang, Y.-J., et al., "The Structural Basis for DNA Binding by an Anti-DNA Autoantibody," Molecular Immunology 35(18):1207-1217, Pergamon Press, England (1998).
Jiang, Y.F., et al., "Recurrence or Metastasis of HCC:Predictors, Early Detection and Experimental Antiangiogenic Therapy," World Journal of Gastroenterology 6(1):61-65, Baishideng Publishing Group, United States (2000).
Johnson, G. and Wu, T.T., "The Kabat Database and a Bioinformatics Example," Methods in Molecular Biology 248:11-25, Humana Press, United States (2004).
Johnson, R.K. and Goldin, A., "The Clinical Impact of Screening and Other Experimental Tumor Studies," Cancer Treatment Reviews 2(1):1-31, Elsevier, Netherlands (1975).
Johnstone., and Thorpe., "Immunochemistry in Practice," Blackwell Scientific Publications, Oxford, pp. 49-50 (1987).

(56) References Cited

OTHER PUBLICATIONS

Jorg, H., et al., "Glypican-3 Is a Potential Tumor Marker for Hepatocellular Carcinoma," Gastroenterology 118(4):A261, (2000).
Kabat, et al., "Sequences of Proteins of Immunological Interest," 1(5):670-720 (1991).
Kabat, et al., "Sequences of Proteins of Immunological Interest (1987)," 91(3242):103, 310, National Institute of Health, Bethesda (1991).
Kaiser J., "First Pass at Cancer Genome Reveals Complex Landscape," Science 313(5792)1370, The American Association for the Advancement of Science, United States (Sep. 2006).
Kappel, C.A., et al., "Regulating Gene Expression in Transgenic Animals," Current Opinion in Biotechnology 3(5):548-553, Elsevier, England (1992).
Kashmiri, S.V., et al., "Generation, Characterization, and In Vivo Studies of Humanized Anticarcinoma Antibody CC49," Hybridoma 14(5):461-473, Mary Ann Liebert, United States (1995).
Katayose, Y., et al., "MUC1-Specific Targeting Immunotherapy with Bispecific Antibodies: Inhibition of Xenografted Human Bile Duct Carcinoma Growth," Cancer Research 56(18):4205-4212, American Association for Cancer Research, United States (1996).
Kawai, H., et al., "New Research Approach to Hepatocellular Carcinoma," Pharma Medica, 20(2):51-59 (2002) with English Translation.
Kawaida, M., et al., "Clinicopathological Significance of the Expression of Glypican-3 in Hepatocellular Carcinoma," Proceedings of the Japanese Society of Pathology 104(1):324, The Japanese Society of Pathology, Japan (2015).
Tsutsumi, S. and Aburatani, H., "DNA Chip/Array Technology," Clinical Laboratory Investigation (Rinsho Kensa), 44(13):1649-1657 (2000) with English Translation.
Khaldoun, A., et al., "Treatment Approaches for Hepatocellular Carcinoma," Clinical Medicine: Oncology 1:11-19, (2007).
Khawli, L.A., et al., "Improved Tumor Localization and Radioimaging with Chemically Modified Monoclonal Antibodies," Cancer Biotherapy and Radiopharmaceuticals 11(3):203-215, Liebert, United States (1996).
Kim, H., et al., "The Heparan Sulfate Proteoglycan GPC3 is a Potential Lung Tumor Suppressor," American Journal of Respiratory Cell and Molecular Biology 29(6):694-701, American Thoracic Society, United States (2003).
Kim, J.K., et al., "Mapping the Site on Human IgG for Binding of the MHC Class I-related Receptor, FcRn," European Journal of Immunology 29(9):2819-2825, Wiley-VCH, Germany (1999).
Kim, S.J., et al., "Antibody Engineering for the Development of Therapeutic Antibodies," Molecules and Cells 20(1):17-29, Korean Society for Molecular and Cellular Biology, Korea (2005).
Kobayashi, H., et al., "Tryptophan H33 Plays an Important Role in Pyrimidine (6-4) Pyrimidone Photoproduct Binding by a High-Affinity Antibody," Protein Engineering Design and Selection 12(10):879-884, Oxford University Press, United States (1999).
Konno, Y., et al., "Fucose Content of Monoclonal Antibodies can be Controlled by Culture Medium Osmolality for High Antibody-dependent Cellular Cytotoxicity," Cytotechnology 64(3):249-265, Kluwer Academic Publishers (2012).
Krusch, M., et al., "NK Cell Anti-Tumor Immune Responses are Impaired by Sorafenib but Not by Sunitinib," Molecular Pharmacology, Drug Resistance Poster II, Ash Annual Meeting Abstracts, Abstract No. 2632, Blood; 112(11); 911 (Nov. 16, 2008).
Krusch, M., et al., "The Kinase Inhibitors Sunitinib and Sorafenib Differentially Affect Reactivity of NK Cells against Renal Cell Cancer," The FASEB Journal; accessed online at www.fasebiorg/cgi/content/meeting_abstract/22/1_MeetingAbstracts/1077.5; FASEB 2008.
Kumar, S., et al., "Molecular Cloning and Expression of the Fabs of Human Autoantibodies in *Escherichia coli*. Determination of the Heavy or Light Chain Contribution to the anti-DNA/-Cardiolipin Activity of the Fab," The Journal of Biological Chemistry 275(45):35129-35136, American Society for Biochemistry and Molecular Biology, United States (Nov. 2000).
Kunkel, J.P., et al., "Comparisons of the Glycosylation of a Monoclonal Antibody Produced Under Nominally Identical Cell Culture Conditions in Two Different Bioreactors," Biotechnology Progress 16(3):462-470, Wiley-Blackwell, United States (2000).
Kunkel, T.A., et al., "Rapid and Efficient Site-Specific Mutagenesis Without Phenotypic Selection," Proceedings of the National Academy of Sciences USA 82(2):488-492, National Academy of Sciences, United States (1985).
Kurokawa, Y., et al., "Molecular Features of Non-B, Non-C Hepatocellular Carcinoma: A PCR-array Gene Rxpression Profiling Study," Journal of Hepatology 39(6)1004-1012, Elsevier, Netherlands (2003).
Lage, H. and Dietel, M., "Cloning and Characterization of Human cDNAs Encoding a Protein with High Homology to Rat Intestinal Development Protein OCI-5," Gene 188(2):151-156, Elsevier/North-Holland, Netherlands (1997).
Lage, H., et al., "Expression of a Glypican-related 62-kDa Antigen Is Decreased in Hepatocellular Carcinoma in Correspondence to the Grade of Tumor Differentiation," Virchows Arch 438(6):567-573, Springer International, Germany (2001).
Lake, R.A. and Robinson, B.W., "Immunotherapy and Chemotherapy—a Practical Partnership," Nature Reviews. Cancer 5(5):397-405, Nature Pub. Group, England (2005).
Lamon, E.W., et al., "Antibody-dependent Cell-mediated Cytotoxicity in the Moloney Sarcoma Virus System: Differential Activity of IgG and IgM with Different Subpopulations of Lymphocytes," The Journal of Experimental Medicine 145(2):302-313, Rockefeller University Press, United States (1977).
Lazar, E., et al., "Transforming Growth Factor α: Mutation of Aspartic Acid 47 and Leucine 48 Results in Different Biological Activities," Molecular and Cellular Biology 8(3):1247-1252, American Society for Microbiology, United States (Mar. 1988).
Lazar., et al., "Declaration," 141 pages (Dec. 2010).
Lewis, G.D.,et al., "Differential Responses of Human Tumor Cell Lines to Anti-p185$^{HER2}$ Monoclonal Antibodies," Cancer Immunology and Immunotherapy 37(4):255-263, Springer Verlag, Germany (1993).
Li, H., et al., "Optimization of Humanized IgGs in Glycoengineered Pichia Pastoris," Nature Biotechnology 24(2):210-215, Nature America Publishing, United States (2006).
Lin, H., et al., "Frequent Silencing of the GPC3 Gene in Ovarian Cancer Cell Lines," Cancer Research 807-810:59(4), American Association for Cancer Research, United States (1999).
Llovet, J.M., et al., "A Molecular Signature to Discriminate Dysplastic Nodules From Early Hepatocellular Carcinoma in HCV Cirrhosis," Gastroenterology 131(6):1758-1767, W.B. Saunders, United States (2006).
Llovet, J.M., et al., "Hepatocellular Carcinoma," Lancet 362(9399):1907-1917, Lancet Publishing Group, England (2003).
Forner, A., et al., "Hepatocellular Carcinoma," Lancet 379(9822):1245-1255, Lancet Publishing Group, United States (2012).
Lobo, E.D., et al., "Antibody Pharmacokinetics and Pharmacodynamics," Journal of Pharmaceutical Sciences 93(11):2645-2668, Wiley-Liss, United States (2004).
Lund, J., et al., "Multiple Interactions of IgG with its Core Oligosaccharide can Modulate Recognition by Complement and Human Fc Gamma Receptor I and Influence the Synthesis of its Oligosaccharide Chains," Journal of Immunology 157(11):4963-4969, American Association of Immunologists, United States (1996).
Ma, J.K., et al., "Assembly of Monoclonal Antibodies With IgG1 and IgA Heavy Chain Domains in Transgenic Tobacco Plants," European Journal of Immunology 24(1):131-138, Wiley-VCH, Germany (1994).
MacCallum, R.M., et al., "Antibody-antigen Interactions: Contact Analysis and Binding Site Topography," Journal of Molecular Biology 262(5):732-745, Elsevier, England (Oct. 1996).
Maeda, S., et al., "Production of Human Alpha-Interferon in Silkworm using a Baculovirus Vector," Nature 315(6020):592-594, Nature Publishing Group, England (1985).

(56) References Cited

OTHER PUBLICATIONS

Man, X.B., et al., "Upregulation of Glypican-3 Expression in Hepatocellular Carcinoma but Downregulation in Cholangiocarcinoma Indicates Its Differential Diagnosis Value in Primary Liver Cancers," Liver International 25(5):962-966, Wiley-Blackwell, United States (2005).

Manuela, S., et al., "The Kinase Inhibitors Sunitinib (Sutent) and Sorafenib (Nexavar) Differentially Affect Reactivity of NK Cells against Renal Cell Cancer," Molecular Pharmacology, Drug Resistance, Abstract No. 4182, Blood; 110(11)(2); 113B (Nov. 2.

Marks, J.D., et al., "By-passing Immunization. Human Antibodies from V-gene Libraries Displayed on Phage," Journal of Molecular Biology 222(3):581-597, Academic Press Limited, United States (Dec. 1991).

Martin, W.L., et al., "Crystal Structure at 2.8 A of an FcRn/Heterodimeric Fc Complex: Mechanism of pH-Dependent Binding," Molecular Cell 7(4):867-877, Cell Press, United States (2001).

Masafumi Ikeda, et al., "Drug Therapy for Primary Liver Cancer and Kinase Inhibitor Sorafenib ," Hematology & Oncology 56(1):70-75, (2008).

Mason, J.T. and O'Leary, T.J., "Effects of Formaldehyde Fixation on Protein Secondary Structure: a Calorimetric and Infrared Spectroscopic Investigation," The Journal of Histochemistry and Cytochemistry 225-229:39(2), SAGE, United States (1991).

Mast, A.E., et al., "Glypican-3 is a Binding Protein on the HepG2 Cell Surface for Tissue Factor Pathway Inhibitor," The Biochemical Journal 327(Pt2):577-583, Portland Press on behalf of the Biochemical Society, England (1997).

Medesan, C., et al., "Delineation of the Amino Acid Residues Involved in Transcytosis and Catabolism of Mouse IgG1," Journal of Immunology 158(5):2211-2217, American Association of Immunologists, United States (1997).

Mendel, D.B., et al., "In Vivo Antitumor Activity of SU11248, a Novel Tyrosine Kinase Inhibitor Targeting vascular Endothelial Growth Factor and Platelet-derived Growth Factor Receptors: Determination of a Pharmacokinetic/Pharmacodynamic Relationship," Clinical Cancer Research 9(1):327-337, The Association, United States (2003).

Mendez, M.J., et al., "Functional Transplant of Megabase Human Immunoglobulin Loci Recapitulates Human Antibody Response in Mice," Nature Genetics 15(2):146-156, Nature Pub. Co., United States (1997).

Mendez-Sanchez, N., et al., "Sorafenib, A Systematic Therapy for Hepatocellular Carcinoma," Annals of Hepatology 7(1):46-51, Fundación Clínica Médica Sur, Mexico (2008).

Midorikawa Proceedings of the American Association for Cancer Research Mar. 2002, 43:11 Abstract 53.

Midorikawa, The 61th Annual meeting of the Japanese Cancer Association, 152 (2002).

Midorikawa, Y., et al., "Glypican-3, Overexpressed in Hepatocellular Carcinoma, Modulates FGF2 and BMP-7 Signaling," International Journal of Cancer 103(4):455-465, Wiley-Liss, United States (2003).

M.I. Cappuro,et al,Overexpression of Glypican-3 in Human Hepatocellular Carcinomas Determined by Immunohitochemistry Using a Monoclonal Antibody,Proceedings of the American Association for Cancer Research Annual Meetinq,Mar. 2002,vol. 43,p. 219.

Motohisa, A. and Karasawa, h., "Matrixeye Portable 3D Ultrasonic Inspection System," Toshiba Review 60:48-51 (2005).

MSNBC News Services, "Mixed Results on New Cancer Drug," 4 pages (2000).

Nahon, P. and Zucman-Rossi, J., "Single Nucleotide Polymorphisms and Risk of Hepatocellular Carcinoma in Cirrhosis," Journal of Hepatology 57(3):663-674, Munksgaard International Publishers, Netherlands (2012).

Nakatsura, T. et al., "Glypican-3, Overexpressed Specifically in Human Hepatocellular Carcinoma, is a Novel Tumor Marker," Biochemical and Biophysical Research Communications 306(1):16-25, Academic Press, New york (2003).

Nakatsura, T., et al., "Glypican-3, Overexpressed Specifically in Human Hepatocellular Carcinoma, May Prove to be Novel Tumor Marker and Potential Candidate for Immunotherapy," Annual meeting of the Japanese Cancer Assoc.; 61:378, Abstract No. 1338; Aug. 25, 2002 (with English translation of title).

Nesterova, A., et al., "Glypican-3 as a novel target for an antibody-drug conjugate," AACR Annual Meeting Apr. 14-18, 2007, Abstract No. 656, (2007).

Nexavar (sorafenib) Prescribing Information; (Nov. 2007).

Niwa, R., et al., "Defucosylated Chimeric Anti-CC Chemokine Receptor 4 IgG1 With Enhanced Antibody-dependent Cellular Cytotoxicity Shows Potent Therapeutic Activity to T-cell Leukemia and Lymphoma," Cancer Research 64(6):2127-2133, American Association for Cancer Research, United States (2004).

Noda, K., et al., "Relationship Between Elevated FX Expression and Increased Production of GDP-L-fucose, a Common Donor Substrate for Fucosylation in Human Hepatocellular Carcinoma and Hepatoma Cell Lines," Cancer Research 63(19):6282-6289, American Association for Cancer Research, United States (2003).

Ober, R.J., et al., "Differences in Promiscuity for Antibody-Fcrn Interactions Across Species: Implications for Therapeutic Antibodies," International Immunology 13(12):1551-1559, Oxford University Press, England (2001).

Office Action issued in connection with U.S. Appl. No. 11/414,676 dated Jan. 22, 2008.

Office Action dated Nov. 22, 2011, in Japanese Patent Application No. 2009-105835.

Ohno, S., et al., "Antigen-Binding Specificities of Antibodies are Primarily Determined by Seven Residues of VH," Proceedings of the National Academy of Sciences USA 82(9):2945-2949, National Academy of Sciences, United States (1985).

Onda, M. et al., "Lowering the Isoelectric Point of the Fv Portion of Recombinant Immunotoxins Leads to Decreased Nonspecific Animal Toxicity without Affecting Antitumor Activity," Cancer Research 61(13):5070-5077, American Association for Cancer Research, United States (2001).

Ono, K., et al., "The Humanized Anti-HM1.24 Antibody Effectively Kills Multiple Myeloma Cells by Human Effector Cell-Mediated Cytotoxicity," Molecular Immunology 36(6):387-395, Pergamon Press, England (1999).

Osawa., et al., "Dictionary of Immunology," (Second Edition), Tokyokagakudojin, p. 243, 560 (2001).

Panka, D.J., et al., "Variable Region Framework Differences Result in Decreased or Increased Affinity of Variant Anti-digoxin Antibodies," Proceedings of the National Academy of Sciences USA 85(9):3080-3084, National Academy of Sciences, United States (May 1988).

Pannetier, C., et al., "The Sizes of the CDR3 Hypervariable Regions of the Murine T-cell Receptor Beta Chains Vary as a Function of the Recombined Germ-line Segments," Proceedings of the National Academy of Sciences of the United States of America 90(9):4319-4323, National Academy of Sciences, United States (1993).

Pardridge, W.M., et al., "Enhanced Endocytosis in Cultured Human Breast Carcinoma Cells and In Vivo Biodistribution in Rats of a Humanized Monoclonal Antibody After Cationization of the Protein," Journal of Pharmacology and Experimental Therapeutics 286(1):548-554, American Society for Pharmacology and Experimental Therapeutics, United States (1998).

Paul, W.E., "Structure and Function of Immunoglobulins," in Fundamental Immunology, Third Edition, pp. 292-295, Raven Press, New York, United States (1993).

Pellegrini, M., et al., "Gpc3 Expression Correlates with the Phenotype of the Simpson-golabi-behmel Syndrome," Developmental Dynamics 213(4):431-439, Wiley, United States (1998).

Petkova, S.B., et al., "Enhanced Half-Life of Genetically Engineered Human IgG1 Antibodies in a Humanized FcRn Mouse Model: Potential Application in Humorally Mediated Autoimmune Disease," International Immunology 18(12):1759-1769, Oxford University Press, England (2006).

Petrov, P.V., "Immunology," M., p. 70 (1987).

Nanzando, et al. "Pharmacokinetics Analysis by Practice," pp. 7-8, 53-58, 85-96 (2003) together with partial English translation (pp. 7-8 and 54-55).

(56) References Cited

OTHER PUBLICATIONS

Philip, P.A., et al., "Phase II Study of Erlotinib (OSI-774) in Patients with Advanced Hepatocellular Cancer," Journal of Clinical Oncology 23(27):6657-6663, American Society of Clinical Oncology, United States (2005).
Piguet, A.C. et al., "Inhibition of mTOR in Combination with Doxorubin in an Experimental Model of Hepatocellular Carcinoma," Journal of Hepatology 49(1):78-87, Munksgaard International Publishers, Netherlands (2008).
Pilia, G., et al., "Mutations in GPC3, a Glypican Gene, Cause the Simpson-golabi-behmel Overgrowth Syndrome," Nature Genetics 12(3):241-247, Nature Pub. Co., United States (1996).
Poduslo, J. F. and Curran, G. L., "Polyamine Modification Increases the Permeability of Proteins at the Blood-Nerve and Blood-Brain Barriers," Journal of Neurochemistry 66(4):1599-1609, Blackwell Science, England (1996).
Janeway, et al., "Antibodies and Cellular Receptors" Immunology (textbook), edited by Raitt, Brostoff and Male, , year 2000 edition.
Powell, C.A., et al., "Oligonucleotide Microarray Analysis of Lung Adenocarcinoma in Smokers and Nonsmokers Identifies GPC3 as a Potential Lung Tumor Suppressor," Chest 121(3Suppl):6S-7S, Elsevier, United States (2002).
Presta, L.G., "Engineering Antibodies for Therapy," Current Pharmaceutical Biotechnology 3(3):237-256, Bentham Science Publishers, Netherlands (2002).
Puck, T.T., et al., "Genetics of Somatic Mammalian Cells. III. Long-Term Cultivation of Euploid Cells From Human and Animal Subjects," The Journal of Experimental Medicine 108(6):945-956, Rockefeller University Press, United States (1958).
Queen, C., et al., "A Humanized Antibody that Binds to the Interleukin 2 Receptor," Proceedings of the National Academy of Sciences USA 86(24):10029-10033, National Academy of Sciences, United States (Dec. 1989).
Raghavan, M. and Bjorkman, P.J., "Fc Receptors and Their Interactions with Immunoglobulins," Annual Review of Cell and Developmental Biology 12:181-220, Annual Reviews, United States (1996).
Rajpal, A., et al., "A General Method for Greatly Improving the Affinity of Antibodies by Using Combinatorial Libraries," Proceedings of the National Academy of Sciences USA 102(24):8466-8471, National Academy of Sciences, United States (2005).
Raju, T.S., "Glycosylation Variations with Expression Systems and their Impact on Biological Activity of Therapeutic Immunoglobulins," BioProcess International 44-53 (2003).
Reichert, J.M. and Valge-Archer, V.E., "Development Trends for Monoclonal Antibody Cancer Therapeutics," Nature Reviews. Drug Discovery 6(5):349-356, Nature Pub. Group, London (2007).
Riechmann, L., et al., "Reshaping Human Antibodies for Therapy," Nature 332(6162):323-327, Nature Publishing Group, United States (Mar. 1988).
Roitt, I.M., et al., "Immunology," pp. 150-152 (2000) (with English translation).
Roitt, I.M., et al., "Immunology," (Fifth Edition), Nankodo, pp. 72-73, 76-77, and 78-79 (2000) (with English translation).
Roitt., I.M., et al., "Immunology," Moscow, pp. 102, 106-107 (2000) (with English translation).
Roitt, I.M., et al Immunology, Moscow, "Mir", p. 110 (2000) (with English translation).
Roskams, T., et al., "Heparan Sulphate Proteoglycan Expression in Human Primary Liver Tumours," The Journal of Pathology 185(3):290-297, John Wiley and Sons, England (1998).
Sabit, H., et al., "Enhanced Expression of Basement-membrane-type Heparan Sulfate Proteoglycan in Tumor Fibro-myxoid Stroma of Intrahepatic Cholangiocarcinoma," Pathology international 51(4):248-256, Blackwell Scientific, Australia (2001).
Saikali, Z. and Sinnett, D., "Expression of Glypican 3 (GPC3) in Embryonal Tumors," International Journal of Cancer 89(5):418-422, Wiley-Liss, United States (2000).
Sanchez-Mejorada, G. and Rosales, C., "Signal Transduction by Immunoglobulin Fc Receptors," Journal of Leukocyte Biology 63(5):521-533, Society for Leukocyte Biology, United States (1998).
Santa Cruz Biotechnology, Inc. Datasheet from Antibody Glypican-3 1-7(W-18) (2001).
Sato, K., et al., "Reshaping a Human Antibody to Inhibit the Interleukin 6-Dependent Tumor Cell Growth," Cancer Research 53(4):851-856, American Association for Cancer Research, United States (1993).
Saxena, R.K., et al., "Identity of Effector Cells Participating in the Reverse Antibody-dependent Cell-mediated Cytotoxicity," Immunology 46(2):459-464, Blackwell Scientific Publications, England (1982).
Schenk, B., et al., "MPDU1 Mutations Underlie a Novel Human Congenital Disorder of Glycosylation, Designated Type If," The Journal of Clinical Investigation 108(11):1687-1695, American Society for Clinical Investigation, United States (2001).
Seaver, "Monoclonal Antibodies in Industry: More Difficult Than Originally Thought," Genetic Engineering 14(14):10, 21 (1994).
Sgroi, D.C., et al., "In Vivo Gene Expression Profile Analysis of Human Breast Cancer Progression," Cancer Research 59(22):5656-5661, American Association for Cancer Research, United States (1999).
Shields, R.L., et al., "High Resolution Mapping of the Binding Site on Human IgG1 for Fc gamma RI, Fc gamma RII, Fc gamma RIII, and FcRn and Design of IgG1 Variants with Improved Binding to the Fc gamma R," The Journal of Biological Chemistry 276(9):6591-6604, American Society for Biochemistry and Molecular Biology, United States (Mar. 2001).
Shields, R.L., et al., "Lack of Fucose on Human IgG1 N-linked Oligosaccharide Improves Binding to Human Fcgamma RIII and Antibody-Dependent Cellular Toxicity," The Journal of Biological Chemistry 277(30):26733-26740, American Society for Biochemistry and Molecular Biology, United States (2002).
Shim, J.H., et al., "Efficacy of Combination Chemotherapy with Capecitabine Plus Cisplatin in Patients with Unresectable Hepatocellular Carcinoma," Cancer Chemotherapy Pharmacology 63(3):459-467, Springer Verlag, Germany (2009).
Shinkawa, T., et al., "The Absence of Fucose but Not the Presence of Galactose or Bisecting N-acetylglucosamine of Human IgG1 Complex-Type Oligosaccharides Shows the Critical Role of Enhancing Antibody-Dependent Cellular Cytotoxicity," The Journal of Biological Chemistry 278(5):3466-3473, American Society for Biochemistry and Molecular Biology, United States (2003).
Shirakawa, H., et al., "Glypican-3 is a Useful Diagnostic Marker for a Component of Hepatocellular Carcinoma in Human Liver Cancer," International Journal of Oncology 34(3):649-656, D.A. Spandidos, Greece (2009).
Shuo., et al., "The Antitumor Effects of Anti-CD71 Mouse/Human Chimeric Antibody in vitro," Journal of Huazhong University of Science and Technology 32(1):13 (2003).
Simpson, D. and Keating, G.M., "Sorafenib: in Hepatocellular Carcinoma," Drugs 68(2):251-258, Adis, Springer International, New Zealand (2008).
Smith, D.L., et al., "Changes in the Proteome Associated With the Action of Bcr-Abl Tyrosine Kinase are not Related to Transcriptional Regulation," Molecular & Cellular Proteomics 1(11):876-884, American Society for Biochemistry and Molecular Biology, United States (2002).
Smith-Gill, S.J., et al., "Contributions of Immunoglobulin Heavy and Light Chains to Antibody Specificity for Lysozyme and Two Haptens," Journal of Immunology 139(12):4135-4144, American Association of Immunologists, United States (Dec. 1987).
Soderlind, E., et al., "The Immune Diversity in a Test Tube-non-immunised Antibody Libraries and Functional Variability in Defined Protein Scaffolds," Combinatorial Chemistry & High Throughput Screening 4(5):409-416, Bentham Science Publishers, Netherlands (2001).
Song, M.K., et al., "Light Chain of Natural Antibody Plays a Dominant Role in Protein Antigen Binding," Biochemical and Biophysical Research Communications 268(2):390-394, Academic Press, United States (Feb. 2000).

(56) References Cited

OTHER PUBLICATIONS

Steplewski, Z., et al, "Biological Activity of Human-Mouse IgG1, IgG2, IgG3, and IgG4 Chimeric Monoclonal Antibodies With Antitumor Specificity," Proceedings of the National Academy of Sciences of the USA 85(13):4852-4856, National Academy of Sciences, United States (1998).
Strategies for Protein Purification and Characterization: A Laboratory Course Manual. Ed. Daniel R. Marshak et al. (1996) Cold Spring Harbor Laboratory Press.
Strome, S.E., et al., "A Mechanistic Perspective of Monoclonal Anitbodies in Cancer Therapy Beyond Target-Related Effects," The Oncologist 12(9):1084-1095, AlphaMed Press, United States (2007).
Sung, Y.K., et al., "Glypican-3 is Overexpressed in Human Hepatocellular Carcinoma," Cancer Science 94(3):259-262, Blackwell Publishing, England (2003).
Tackels-Horne, D., et al., "Identification of Differentially Expressed Genes in Hepatocellular Carcinoma and Metastatic Liver Tumors by Oligonucleotide Expression Profiling," Cancer 92(2):395-405, Wiley, United States (2001).
Takebe, T., et al., "SR Alpha Promoter: An Efficient and Versatile Mammalian Cdna Expression System Composed of the Simian Virus 40 Early Promoter and the R-U5 Segment of Human T-Cell Leukemia Virus Type 1 Long Terminal Repeat," Molecular and Cell Biology 8(1):466-472, American Society for Microbiology, United States (1988).
Takenaka, K., et al., "Results of 280 Liver Resections for Hepatocellular Carcinoma," Archives of Surgery 131:71-76, American Medical Association, United States (1996).
Tang, Z.Y., et al., "Metastatic Human Hepatocellular Carcinoma Models in Nude Mice and Cell Line With Metastatic Potential," World Journal of Gastroenterology 7(5):597-601, Baishideng Publishing Group, United States (2001).
Tannapfel, A. and Wittekind, C., "Genes Involved in Hepatocellular Carcinoma: Deregulation in Cell Cycling and Apoptosis," Virchows Archiv 440(4):345-352, Springer International, Germany (2002).
"The Bjorkman Declaration," 14 pages (Jan. 2011).
Thomas, M.B., et al, "A Phase II Open-label Study of OSI-774 (NSC 718781) in Unresectable Hepatocellular Carcinoma," Journal of Clinical Oncology 23(16S):4038, (2005).
Timar, J., et al., "Proteoglycans and Tumor Progression: Janus-faced Molecules With Contradictory Functions in Cancer," Seminars in Cancer Biology 12(3):173-186, Academic Press, England (2002).
Tsurushita, N., et al., "Design of Humanized Antibodies: From Anti-Tac to Zenapax," Methods 36(1):69-83, Academic Press, United States (2005).
Uhm, J.E., et al., "A Phase II Study of Oxaliplatin in Combination with Doxorubicin as First-Line Systemic Chemotherapy in Patients with Inoperable Hepatocellular Carcinoma," Cancer Chemotherapy and Pharmacology 63(5):929-935, Springer Verlag, Germany (2009).
Uka, K., et al, "Combination Therapy of Oral Fluoropyrimidine Anticancer Drug S-1 and Interferon alpha for HCC Patients with Extrahepatic Metastases," Oncology 75(1-2):8-16, Karger, Switzerland (2008).
Uka, K., et al., "Systemic Gemcitabine Combined with Intra-Arterial Low-Dose Cisplatin and 5-Fluorouracil for Advanced Hepatocellular Carcinoma: Seven Cases," World Journal of Gastroenterology 14(16):2602-2608, Baishideng Publishing Group, United States (2008).
Vaisitti, T., et al., "Cationization of Monoclonal Antibodies: Another Step Towards the "Magic Bullet"?," Journal of Biological Regulators & Homeostatic Agents 19(3-4):105-112, Biolife, Italy (2005).
Vajdos, F.F., et al., "Comprehensive Functional Maps of the Antigen-Binding Site of an Anti-ErbB2 Antibody obtained with Shotgun Scanning Mutagenesis," Journal of Molecular Biology 320(2):415-428, Elsevier Science, United States (Jul. 2002).
Valle, G., et al., "Synthesis and Secretion of Mouse Immunoglobulin Chains From Xenopus Oocytes," Nature 291:338-340, Nature Publishing Group, England (1981).
Veugelers, M., et al., "The Glypicans: a Family of GPI-Anchored Heparan Sulfate Proteoglycans with a Potential Role in the Control of Cell Division," Trends in Glycoscience and Glycotechnology 10(52):145-152 (1998).
Voskoglou-Nomikos, T., et al., "Clinical Predictive Value of the in Vitro Cell Line, Human Xenograft, and Mouse Allograft Preclinical Cancer Models," Clinical Cancer Research 9(11):4227-4239, The Association, United States (Sep. 2003).
Wall, R.J., "Transgenic Livestock: Progress and Prospects for the Future," Theriogenology 45(1):57-68, Elsevier Science Inc., United States (1996).
Wang, T., et al., "Identification of Genes Differentially Overexpressed in Lung Squamous Cell Carcinoma Using Combination of cDNA Subtraction and Microarray Analysis," Oncogene 19(12):1519-1528, Nature Publishing Group, England (2000).
Wang, W., et al., "Monoclonal Antibody Pharmacokinetics and Pharmacodynamics," Clinical Pharmacology and Therapeutics 84(5):548-558, Wiley, United States (2008).
Waterhouse, P., et al., "Combinatorial Infection and in Vivo Recombination: A Strategy for making Large Phage Antibody Repertoires," Nucleic Acids Research 21(9):2265-2266, Oxford University Press, England (May 1993).
Weitzhandler, M., et al., "Analysis of Carbohydrates on IgG Preparations," Journal of Pharmaceutical Sciences 83(12):1670-1675, American Pharmaceutical Assn, United States (1994).
White, G.R.M., et al., "Somatic Glypican 3 (GPC3) Mutations in Wilms' Tumour," British Journal of Cancer 86(12):1920-1922, Cancer Research, England (2002).
Wichert, A., et al., "Glypican-3 is Involved inCcellular Protection Against Mitoxantrone in Gastric Carcinoma Cells," Oncogene 23(4):945-955, Nature Publishing Group, England (2004).
Winkler, K., et al., "Changing the Antigen Binding Specificity by Single Point Mutations of an Anti-p24 (HIV-1) Antibody," The Journal of Immunology 165(8):4505-4514, The American Association of Immunologists, United States (2000).
Winter, G. and Harris, W.J., "Humanized Antibodies," Immunology Today 14(6):243-246, Elsevier Science Publishers, England (1993).
Wu, H., et al., "Humanization of a Murine Monoclonal Antibody by Simultaneous Optimization of Framework and CDR Residues," Journal of Molecular Biology 294(1):151-162, Elsevier, England (Nov. 1999).
Wu, T.T., et al., "Length Distribution of CDRH3 in Antibodies," Proteins 16(1):1-7, Wiley-Liss, United States (1993).
Xiang, Y.Y., et al, "Glypican-3 Expression Is Silenced in Human Breast Cancer," Oncogene 20(50):7408-7412, Nature Publishing Group, England (2001).
Xu, C., et al., "Identification of Differentially Expressed Genes in Human Prostate Cancer Using Subtraction and Microarray," Cancer Research 60(6):1677-1682, American Association for Cancer Research, United States (2000).
Xu, Y., et al., "Developmental Regulation of the Soluble Form of Insulin-like Growth Factor-ii/mannose 6-phosphate Receptor in Human Serum and Amniotic Fluid," The Journal of Clinical Endocrinology and Metabolism 83(2):437-442, Oxford University Press, United States (1998).
Yagi, T., et al., "Homologous Recombination at c-fyn Locus of Mouse Embryonic Stem Cells With Use of Diphtheria Toxin A-Fragment Gene in Negative Selection," Proceedings of the National Academy of Sciences 87(24):9918-9922, National Academy of Sciences, United States (1990).
Yamaguchi., et al., "Current Status and Future Perspective of Biotherapy for Cancer," Biotherapy 13:747-753 (1999).
Yamane-Ohnuki, N., et al., "Establishment of FUT8 Knockout Chinese Hamster Ovary Cells: An Ideal Host Cell Line for Producing Completely Defucosylated Antibodies with Enhanced Antibody-Dependent Cellular Cytotoxicity," Biotechnology and Bioengineering 87(5):614-622, Wiley, United States (2004).
Yamasaki, Y., et al., "Pharmacokinetic Analysis of In Vivo Disposition of Succinylated Proteins Targeted to Liver Nonparenchymal Cells Via Scavenger Receptors: Importance of Molecular Size and Negative Charge Density for In Vivo Recognition by Receptors," Journal of Pharmacology and Experimental Therapeutics

(56) References Cited

OTHER PUBLICATIONS

301(2):467-477, American Society for Pharmacology and Experimental Therapeutics, United States (2002).

Yen, Y., et al, "Phase I/II Study of PHY906/Capecitabine in Advance Hepatocellular Cancer," Anticancer Research 29(10):4083-4092, International Institute of Anticancer Research, Greece (2009).

Yeo, W., et al., "Randomized Phase III Study of Doxorubicin Versus Cisplatin/Interferon alpha-2b/Doxorubicin/Fluorouracil (PIAF) Combination Chemotherapy for Unresectable Hepatocellular Carcinoma," Journal National Cancer Institute 97(20):1532-1538, Oxford University Press, United States (2005).

Zellner, A., et al., "Disparity in Expression of Protein Kinase C alpha in Human Glioma Versus Glioma-derived Primary Cell Lines: Therapeutic Implications," Clinical Cancer Research 4(7):1797-1802, The Association, United States (1998).

Zhao, L., et al. , "Synergistic Effect of 5-Fluorouracil and the Flavanoid Oroxylin A on HepG2 Human Hepatocellular Carcinoma and on H22 Transplanted Mice," Cancer Chemotherapy and Pharmacology 65(3):481-489, Springer Verlag, Germany (2010).

Zhu, A., et al., "Efficacy, Safety, and Changes in Angiogenic Markers Following Sunitinib Monotherapy in Patients with Advanced Hepatocellular Carcinoma: Experience from a Phase II Study," 99thAACR annual meeting. San Diego, CA, USA 12-16, (2008).

Zhu, A.X., "Development of Sorafenib and Other Molecularly Targeted Agents in Hepatocellular Carcinoma," Cancer 112(2):250-259, Wiley, United States (2008).

Zhu, A.X., et al., "First-in-man Phase I Study of GC33, a Novel Recombinant Humanized Antibody Against Glypican-3, in Patients with Advanced Hepatocellular Carcinoma," Clinical Cancer Research 19(4):920-928, The Association, United States (2013).

Zhu, Z., et al., "Glypican-3 Expression Is Markedly Decreased in Human Gastric Cancer but Not in Esophageal Cancer," American Journal of Surgery 184(1):78-83, Excerpts Medica, United States (2002).

Zhu, Z.W., et al., "Enhanced Glypican-3 Expression Differentiates the Majority of Hepatocellular Carcinomas From Benign Hepatic Disorders," Gut 48(4):558-564, British Medical Assn, England (2001).

Zips, D., et al., New Anticancer Agents: In Vitro and In Vivo Evaluation, 19: 1-8, (2005).

Zuckier, L.S., et al., "Chimeric Human-Mouse IgG Antibodies with Shuffled Constant Region Exons Demonstrate that Multiple Domains Contribute to In Vivo Half-Life," Cancer Research 58(17):3905-3908, American Association for Cancer Research, United States (1998).

Zynger, D.L., et al., "Glypican-3: A Novel marker in Testicular Germ Cell Tumors," American Journal of Surgical Pathology 30(12):1570-1575, Raven Press, New York (2006).

Kontermann, R.E., "Dual Targeting Strategies with Bispecific Antibodies," mAbs 4(2):182-197, Taylor and Francis, United States (2012).

Amann, M., et al., "Therapeutic Window of an EpCAM/CD3-specific BITE Antibody in Mice is Determined by a Subpopulation of EpCAM-expressing Lymphocytes that is Absent in Humans," Cancer Immunology, Immunotherapy 58(1):95-109, Springer Verlag, Germany (2009).

Amendment and Reply to Office Action dated Apr. 12, 2017 in U.S. Appl. No. 14/680,154, filed Apr. 7, 2015, 70 pages.

Campoli, M., et al., "Immunotherapy of Malignant Disease with Tumor Antigen-specific Monoclonal Antibodies," Clinical Cancer Research 16(1):11-20, The Association, United States (2010).

Chan, A.C. and Carter, P.J., "Therapeutic Antibodies for Autoimmunity and Inflammation," Nature Reviews. Immunology 10(5):301-316, Macmillan Publishers Limited, England (2010).

Hess, J., et al., "Cancer Therapy with Trifunctional Antibodies: Linking Innate and Adaptive Immunity," Future Oncology 8(1):73-85, Future Medicine Ltd., England (2012).

International Preliminary Report on Patentability for International Application No. PCT/JP2015/077024, the International Bureau of WIPO, Geneva, Switzerland, issued on Mar. 28, 2017, 13 pages.

International Search Report for International Application No. PCT/JP2015/077024, Japan Patent Office, Tokyo, dated Dec. 8, 2015, 6 pages.

Jefferis, R. and Lund, J., "Interaction Sites on Human IgG-Fc for FcgammaR: Current Models," Immunology Letters 82(1-2):57-65, Elsevier/North-Holland Biomedical Press, Netherlands (2002).

Jones, H.E., et al., "Growth factor receptor interplay and resistance in cancer," Endocrine-Related Cancer 13:S45-S51, Society for Endocrinology, Great Britain (2006).

Merchant, A.M., et al., "An Efficient Route to Human Bispecific IgG," Nature Biotechnology 16(7):677-681, Nature Publishing Group, United States (1998).

Mezzanzanica, D., et al., "Human Ovarian Carcinoma Lysis by Cytotoxic T Cells Targeted by Bispecific Monoclonal Antibodies: Analysis of the Antibody Components," International Journal of Cancer 41(4):609-615, Wiley-Liss, United States (1988).

Nakano, K., et al., "Anti-Glypican 3 Antibodies Cause ADCC Against Human Hepatocellular Carcinoma Cells," Biochemical and Biophysical Research Communications 378(2):279-284, Academic Press, United States (2009).

Natsume, A., et al., "Improving Effector Functions of Antibodies for Cancer Treatment: Enhancing ADCC and CDC," Drug Design, Development and Therapy 3:7-16, Dove Press Limited, New Zealand (2009).

Nimmerjahn, F. and Ravetch, J.V., "Fcgamma Receptors as Regulators of Immune Responses," Nature Reviews Immunology 8(1):34-47, Nature Publishing Group, England (2008).

Pavlou, A.K. and Belsey, M.J., "The Therapeutic Antibodies Market to 2008," European Journal Pharmaceutics and Biopharmaceutics 59(3):389-396, Elsevier Science, Netherlands (2005).

Radaev, S., et al., "The Structure of a Human Type III Fcgamma Receptor in Complex with Fc," The Journal of Biological Chemistry 276(19):16469-16477, American Society for Biochemistry and Molecular Biology, United States (2001).

Reichert, J.M., et al., "Monoclonal Antibody Successes in the Clinic," Nature Biotechnology 23(9):1073-1078, Nature America Publishing, United States (2005).

Ridgway, J.B., et al., "Knobs-Into-Holes' Engineering of Antibody CH3 Domains for Heavy Chain Heterodimerization," Protein Engineering 9(7):617-621, Oxford University Press, England (1996).

Riechelmann, H., et al., "Adoptive Therapy of Head and Neck Squamous Cell Carcinoma with Antibody Coated Immune Cells: A Pilot Clinical Trial," Cancer Immunology, Immunotherapy 56(9):1397-1406, Springer Verlag, Germany (2007).

Rothe, A., and Rubbert, A., "Recombinant Proteins in Rheumatology—Recent Advances," New Biotechnology 28(5):502-510, Elsevier, Netherlands (2011).

Schlereth, B., et al., "T-cell Activation and B-cell Depletion in Chimpanzees Treated with a Bispecific Anti-CD19/Anti-CD3 Single-chain Antibody Construct," Cancer Immunology, Immunotherapy 55(5):503-514, Springer Verlag, Germany (2006).

Sebastian, M., et al., "Treatment of Non-small Cell Lung Cancer Patients with the Trifunctional Monoclonal Antibody Catumaxomab (anti-EpCAM x anti-CD3): A Phase I Study," Cancer Immunology, Immunotherapy 56(10):1637-1644, Springer Verlag, Germany (2007).

Seimetz, D., et al., "Development and Approval of the Trifunctional Antibody Catumaxomab (anti-EpCAM x anti-CD3) as a Targeted Cancer Immunotherapy," Cancer Treatment Reviews 36(6):458-467, Elsevier, Netherlands (2010).

Staerz, U.D., and Bevan, M.J., "Hybrid Hybridoma Producing a Bispecific Monoclonal Antibody that can Focus Effector T-cell Activity," Proceedings of the National Academy of Sciences USA 83(5):1453-1457, National Academy of Sciences, United States (1986).

Staerz, U.D., et al., "Hybrid Antibodies Can Target Sites for Attack by T Cells," Nature 314(6012):628-631, Nature Publishing Group, England (1985).

(56) References Cited

OTHER PUBLICATIONS

Unkeless, J.C., et al., "Structure and Function of Human and Murine Receptors for IgG," Annual Review of Immunology 6:251-281, Annual Reviews Inc., United States (1988).

Wozniak-Knopp, G., et al., "Introducing Antigen-binding Sites in Structural Loops of Immunoglobulin Constant Domains: Fc Fragments with Engineered HER2/neu-binding Sites and Antibody Properties," Protein Engineering, Design and Selection 23(4):289-297, Oxford University Press, England (2010).

Yin, G., et al., "Aglycosylated antibodies and antibody fragments produced in a scalable in vitro transcription-translation system," MAbs 4(2):217-225, Landes Bioscience, (2012).

Zeidler, R., et al., "Simultaneous Activation of T Cells and Accessory Cells by a New Class of Intact Bispecific Antibody Results in Efficient Tumor Cell Killing," Journal of Immunology 163(3):1246-1252, American Association of Immunologists, United States (1999).

Office Action dated Jan. 13, 2017, in U.S. Appl. No. 14/680,154, Hasegawa, M., et al., filed Apr. 7, 2015, 15 pages.

Almagro, J.C. and Fransson, J., "Humanization of Antibodies," Frontiers in Bioscience 13:1619-1633, Frontiers in Bioscience Publications, United States (2008).

Armour, K.L., et al., "Recombinant Human IgG Molecules Lacking Fcgamma Receptor I Binding and Monocyte Triggering Activities," European Journal of Immunology 29(8):2613-2624, Wiley-VCH, Germany (Aug. 1999).

Arndt, K. M., et al., "Factors Influencing the Dimer to Monomer Transition of an Antibody Single-Chain Fv Fragment," Biochemistry 37:12918-12926, American Chemical Society, United States (1998).

Asano, R., et al., "Highly Effective Recombinant Format of a Humanized IgG-like Bispecific Antibody for Cancer Immunotherapy with Retargeting of Lymphosytes to Tumor Cells," The Journal of Biological Chemistry 282(38):27659-27665, The American Society for Biochemistry and Molecular Biology, Inc., United States (2007).

Aslan, F. M., et al., "Engineering a novel, stable dimeric streptavidin with lower isoelectric point," Journal of Biotechnology 128:213-225, Elsevier, United States (2007).

Atwell, S., et al., "Stable Heterodimers from Remodeling the Domain Interface of a Homodimer using a Phage Display Library," J. Mol. Biol. 270:26-35, Academic Press Limited, United States (1997).

Baerga-Ortiz, A., et al., "Two different proteins that compete for binding to thrombin have opposite kinetic and thermodynamic profiles," Protein Science 13:166-176, The Protein Society, United States (2004).

Bargou, R., et al., "Tumor Regression in Cancer Patients by Very Low Doses of T Cell-Engaging Antibody," Science 321:974-977 (2008).

Bartelds, G.M., et al., "Clinical Response to Adalimumab: Relationship to Anti-adalimumab Antibodies and Serum Adalimumab Concentrations in Rheumatoid Arthritis," Annals of the Rheumatic Diseases 66(7):921-926, BMJ, England (2007).

Batra, S.K., et al., "Pharmacokinetics and Biodistribution of Genetically Engineered Antibodies," Current Opinion in Biotechnology 13(6):603-608, Current Biology, England (2002).

Bender, N.K., et al., "Immunogenicity, Efficacy and Adverse Events of Adalimumab in RA Patients," Rheumatology International 27(3):269-274, Springer International, Germany (2007).

Bokemeyer, C., "Catumaxomab—trifunctional anti-EpCAM antibody used to treat malignant ascites," Expert Opin. Biol. Ther. 10(8):1259-1269, Informa UK Ltd., United Kingdom (2010).

Brown, M., et al., "Tolerance to Single, but not Multiple, Amino Acid Replacements in Antibody VH CDR2: A Means of Minimizing B Cell Wastage from Somatic Hypermutation?," Journal of Immunology 156(9):3285-3291, American Association of Immunologists, United States (May 1996).

Chatellier, J., et al., "Functional Mapping of Conserved Residues Located at the VL and VH Domain Interface of a Fab," J. Mol. Biol 264:1-8, Academic Press Limited, United States (1996).

Chau, L.A., et al., "HuM291(Nuvion), a Humanized Fc Receptor-Nonbinding Antibody Against CD3, Anergizes Peripheral Blood T Cells as Partial Agonist of the T Cell Receptor," Transplantation 71(7):941-950, Lippincott Williams & Wilkins, United States (2001).

Chen, C., et al., "Generation and Analysis of Random Point Mutations in an Antibody CDR2 Sequence: Many Mutated Antibodies Lose their Ability to Bind Antigen," The Journal of Experimental Medicine 176(3):855-866, Rockefeller University Press, United States (1992).

Chen, C., et al., "Defective Secretion of an Immunoglobulin Caused by Mutations in the Heavy Chain Complementarity Determining Region 2," The Journal of Experimental Medicine 180(2):577-586, Rockefeller University Press, United States (1994).

Chirino, A.J., et al., "Minimizing the Immunogenicity of Protein Therapeutics," Drug Discovery Today 9(2):82-90, Elsevier Science Ltd., England (Jan. 2004).

Choi, H., et al., "Engineering of Immunoglobulin Fc Heterodimers Using Yeast Surface-Displayed Combinatorial Fc Library Screening," PLoS ONE 10(12):1-20, e0145349. doi:10.1371/journal.pone. 0145349 (2015).

Chu, G.C., et al., "Accumulation of Succinimide in a Recombinant Monoclonal Antibody in Mildly Acidic Buffers Under Elevated Temperatures," Pharmaceutical Research 24(6):1145-1156, Kluwer Academic, United States (2007).

Cole, M.S., et al., "Human IgG2 Variants of Chimeric Anti-CD3 are Nonmitogenic to T Cells," Journal of Immunology 159(7):3613-3621, American Association of Immunologists, United States (1997).

Coloma, M. J., et al., "Position Effects of Variable Region Carbohydrate on the Affinity and in Vivo Behavior of an Anti-(1-6) Dextran Antibody," Journal of Immunology 162(4):2162-2170, American Association of Immunologists, United States (1999).

Comper, W.D. and Glasgow, E.F., "Charge Selectivity in Kidney Ultrafiltration," Kidney International 47(5):1242-1251, Elsevier, England (1995).

Cordoba, A. J., et al., "Non-enzymatic hinge region fragmentation of antibodies in solution," Journal of Chromatography. B, Analytical Technologies in the Biomedical and Life Sciences 818(2):115-121, Elsevier, Netherlands (2005).

Dall'Acqua, W. F., et al., "Modulation of the Effector Functions of a Human IgG1 through Engineering of Its Hinge Region," The Journal of Immunology 177:1129-1138, The American Association of Immunologists, Inc., United States (2006).

Damschroder, M.M., et al., "Framework Shuffling of Antibodies to Reduce Immunogenicity and Manipulate Functional and Biophysical Properties," Molecular Immunology 44(11):3049-3060, Pergamon Press, England (2007).

Davies, J. and Riechmann, L., "Antibody VH Domains as Small Recognition Units," Biotechnology 13:475-479, Nature Publishing Group, United Kingdom (1995).

De Groot, A.S., et al., "De-immunization of Therapeutic Proteins by T-cell Epitope Modification," Developments in Biologicals 122:171-194, Karger, Switzerland (2005).

Deen, W.M., et al., "Structural Determinants of Glomerular Permeability," American Journal of Physiology 281(4):F579-F596, American Physiological Society, United States (2001).

Del Rio, G., et al., "An Engineered Penicillin Acylase With Altered Surface Charge Is More Stable in Alkaline pH," Annals of the New York Academy of Sciences 799:61-64, Blackwell, United States (1996).

Diaz, M. A. A. A., et al., "Effects of engineering charged amino acids in the $C_H3$ domains on antibody heavy chain dimeritization," Philippine Science Letters 4(1):48-55 (2011).

Fujii, I., et al., "Antibody Affinity Maturation by Random Mutagenesis," Methods in Molecular Biology 248:345-359, Humana Press, United States (2004).

Gerstner, R.B., et al., "Sequence Plasticity in the Antigen-binding Site of a Therapeutic Anti-HER2 Antibody," Journal of Molecular Biology 321(5):851-862, Elsevier, England (2002).

(56) References Cited

OTHER PUBLICATIONS

Gessner, J.E., et al., "The IgG Fc Receptor Family," Annals of Hematology 76(6):231-248, Springer International, Germany (1998).
Goode, N.P., et al., "The Glomerular Basement Membrane Charge-selectivity Barrier: an Oversimplified Concept?," Nephrology, Dialysis, Transplantation 11(9):1714-1716, Springer International, England (1996).
Gramer, M. J., et al., "Production of stable bispecific IgG1 by controlled Fab-arm exchange," mAbs 5(6):962-973, Landes Bioscience, United States (2013).
Griffin, L. M., et al., "Analysis of heavy and light chain sequences of conventional camelid antibodies from *Camelus dromedarius* and *Camelus bactrianus* species," Journal of Immunological Methods 405:35-46, Elsevier B.V., United Kingdom (2014).
Gunasekaran, K., et al., "Enhancing Antibody Fc Heterodimer Formation through Electrostatic Steering Effects," The Journal of Biological Chemistry 285(25):19637-19646, The American Society for Biochemistry and Molecular Biology, Inc., United States (2010).
Guyre, PM et al., "Increased potency of Fc-receptor-targeted antigens," Cancer Immunology, Immunotherapy 45(3-4):146-148, Springer International, Germany (1997).
Hamers-Casterman, C., et al., "Naturally occurring antibodies devoid of light chains," Nature 363:446-448, Nature Publishing Group, United Kingdom (1993).
Hird, V., et al, "Tumour Localisation With a Radioactively Labelled Reshaped Human Monoclonal Antibody," British Journal of Cancer 64(5):911-914, Nature Publishing Group, England (1991).
Hong., et al., "Enhanced Cellular Uptake and Transport of Polyclonal Immunoglobulin G and Fab After Their Cationization," Journal of Drug Targeting 8(2):67-77, Informa Healthcare, England (2000).
Igawa, T., et al., "$V_H/V_L$ interface engineering to promote selective expression and inhibit conformational isomerization of thrombopoietin receptor agonist single-chain diabody," Protein Engineering, Design & Selection 23(8):667-677, Oxford University Press, United Kingdom (2010).
Ito, W., et al., "The His-probe Method: Effects of Histidine Residues Introduced Into the Complementarity-determining Regions of Antibodies on Antigen-antibody Interactions at Different pH Values," FEBS Letters 309(1):85-88, John Wiley & Sons, England (1992).
Janeway, Immunobiology, 5th Edition, Chapter 3, Garland Science, New York (2001).
Janeway, Immunobiology, 5th Edition, Chapter 4, Garland Science, New York (2001).
Johnson, K.A., et al., "Cation Exchange-HPLC and Mass Spectrometry Reveal C-Terminal Amidation of an IgG1 Heavy Chain," Analytical Biochemistry 360(1):75-83, Academic Press, United States (2007).
Johnson, G. and Wu, T. T., "Kabat Database and its applications: 30 years after the first variability plot," Nucleic Acids Research 28(1):214-218, Oxford University Press, United Kingdom (2000).
Jones, T.D., et al., "Identification and Removal of a Promiscuous CD4+ T Cell Epitope from the C1 Domain of Factor VIII," Journal of Thrombosis and Haemostasis 3(5):991-1000, Blackwell Pub, England (2005).
Jung, S., et al., "The Importance of Framework Residues H6, H7 and H10 in Antibody Heavy Chains: Experimental Evidence for a New Structural Subclassification of Antibody $V_H$ Domains," J. Mol. Biol. 309:701-716, Academic Press, United States (2001).
Kabat., et al., "Sequences of Proteins of Immunological Interest," U.S. Dept. of Health & Human Services 1(5):690, 693 (1991).
Khalifa, M. B., et al., "Effects on interaction kinetics of mutations at the VH-VL interface of Fabs depend on the structural context," J. Mol. Recognit. 13:127-139, John Wiley & Sons, Ltd., United Kingdom (2000).
Kim, I., et al., "Lowering of pI by Acylation Improves the Renal Uptake of 99mTc-Labeled anti-Tac dsFv: Effect of Different Acylating Reagents," Nuclear Medicine and Biology 29(8):795-801, Elsevier, United States (2002).
Kim, I.S., et al., "Chemical Modification to Reduce Renal Uptake of Disulfide-bonded Variable Region Fragment of Anti-tac Monoclonal Antibody Labeled With 99mTc," Bioconjugate Chemistry 10(3):447-453, American Chemical Society, United States (1999).
Kipriyanov, S. M., et al., "Effect of Domain Order on the Activity of Bacterially Produced Bispecific Single-chain Fv Antibodies," J. Mol. Biol. 330:99-111, Elsevier Science Ltd., United Kingdom (2003).
Kipriyanov, S. M., et al.,"Bispecific Tandem Diabody for Tumor Therapy with Improved Antigen Binding and Pharmacokinetics," J. Mol. Biol. 293:41-56, Academic Press, United States (1999).
Kobayashi, H., et al., "The Pharmacokinetic Characteristics of Glycolated Humanized Anti-tac Fabs Are Determined by their Isoelectric Points," Cancer Research 59(2):422-430, American Association for Cancer Research, United States (1999).
Komissarov, A.A., et al., "Site-specific Mutagenesis of a Recombinant Anti-single-stranded DNA Fab. Role of Heavy Chain Complementarity-determining Region 3 Residues in Antigen Interaction," 272(43):26864-26870, American Society for Biochemistry and Molecular Biology, United States (1997).
Kontermann, R. E., "Recombinant bispecific antibodies for cancer therapy," Acta Pharmacologica Sinica 26(1):1-9 (2005).
Korn, T., et al., "Recombinant bispecific antibodies for the targeting of adenoviruses to CEA-expressing tumour cells: a comparative analysis of bacterially expressed single-chain diabody and tandem scFv," J. Gene Med. 6:642-651, John Wiley & Sons, Ltd., United Kingdom (2004).
Kufer, P., et al., "A revival of bispecific antibodies," Trends in Biotechnology 22(5):238-244, Elsevier Ltd., United Kingdom (2004).
Kumagai, et al., "Humanized Bispecific Antibodies that Recognize Lymphocytes and Cancer Cells," Drug Delivery System 23(5):518-525 (2008).
Komissarov, A. A., et al., "Site-specific Mutagenesis of a Recombinant Anti-single-stranded DNA Fab," J. of Biol. Chem. 272(43):26864-26870, The American Society for Biochemistry and Molecular Biology, Inc., United States (1997).
Kurfis, J., et al., "Role of Arg182 in the Second Extracellular Loop of Angiotensin II Receptor AT2 in Ligand Binding," Biochem. Biophys. Res. Comm. 263:816-819, Academic Press, United States (1999).
Labrijn, A. F., et al., "Efficient generation of stable bispecific IgG1 by controlled Fab-arm exchange," PNAS 110(13):5145-5150 (2013).
Labrijn, A. F., et al., "Species-Specific Determinants in the IgG CH3 Domain Enable Fab-Arm Exchange by Affecting the Noncovalent CH3—CH3 Interaction Strength," The Journal of Immunology 187:3238-3246, The American Association of Immunologists, Inc., United States (2011).
Le Gall, F., et al., "Effect of linker sequences between the antibody variable domains on the formation, stability and biological activity of a bispecific tandem diabody," Protein Engineering, Design & Selection 17(4):357-366, Oxford University Press, United Kingdom (2004).
Leong, S.R., et al., "Adapting Pharmacokinetic Properties of a Humanized Anti-interleukin-8 Antibody for Therapeutic Applications using Site-specific Pegylation," Cytokine 16(3):106-119, Elsevier Science Ltd., England (Nov. 2001).
Li, B., et al., "Construction and Characterization of a Humanized Anti-human CD3 Monoclonal Antibody 12F6 With Effective Immunoregulation Functions," Immunology 116(4):487-498, Blackwell Scientific, England (2005).
Lin, Y.S., et al., "Preclinical Pharmacokinetics, Interspecies Scaling, and Tissue Distribution of a Humanized Monoclonal Antibody Against Vascular Endothelial Growth Factor," The Journal of Pharmacology and Experimental Therapeutics 288(1):371-378, American Society for Pharmacology and Experimental Therapeutics, United States (1999).
Liu, X. Y., et al., "Functional interactions between arginine-133 and aspartate-88 in the human reduced folate carrier: evidence for a charge-pair association," Biochem. J. 358:511-516, Biochemical Society, Great Britain (2001).

(56) References Cited

OTHER PUBLICATIONS

Liu, H., et al., "Heterogeneity of Monoclonal Antibodies," Journal of Pharmaceutical Sciences 97(7):2426-2447, Wiley-Liss, United States (Jul. 2008).
Mack, M., et al., "A small bispecific antibody construct expressed as a functional single-chain molecule with high tumor cell cytotoxicity," Proc. Natl. Acad. Sci. USA 92:7021-7025 (1995).
Maini, R.N., et al, "Double-blind Randomized Controlled Clinical Trial of the Interleukin-6 Receptor Antagonist, Tocilizumab, in European Patients With Rheumatoid Arthritis Who Had an Incomplete Response to Methotrexate," 54(9):2817-2829, Wiley-Blackwell, United States (2006).
Maity, H., et al., "Equilibrium unfolding of dimeric and engineered monomeric forms of lambda Cro (F58W) repressor and the effect of added salts: evidence for the formation of folded monomer induced by sodium perchlorate," Arch. Biochem. Biophys. 434(1):93-107 (2005).
Marshall, S.A., et al., "Rational Design and Engineering of Therapeutic Proteins," Drug Discovery Today 8(5):212-221, Elsevier Science Ltd, Irvington, New Jersey (2003).
Marti, D. N., et al., "Inverse Electrostatic Effect: Electrostatic Repulsion in the Unfolded State Stabilizes a Leucine Zipper," Biochemistry 43:12436-12447, American Chemical Society, United States (2004).
Marvin, J. S., and Zhu, Z., "Recombinant approaches to IgG-like bispecific antibodies," Acta Pharmacologica Sinica 26(6):649-658, Blackwell Publishing (2005).
McEarchern, J. A., et al., "Engineered anti-CD70 antibody with multiple effector functions exhibits in vitro and in vivo antitumor activities," Blood 109:1185-1192, The American Society of Hematology, United States (2007).
McPhee, F., et al., "Engineering human immunodeficiency virus 1 protease heterodimers as macromolecular inhibitors of viral maturation," Proc. Natl. Acad. Sci. 93:11477-11481 (1996).
Mølhøj, M., et al., "CD19-/CD3-bispecific antibody of the BiTE class is far superior to tandem diabody with respect to redirected tumor cell lysis," Molecular Immunology 44:1935-1943, Elsevier Ltd., United Kingdom (2007).
Murata, V.M., et al., "Anti-digoxin Fab Variants Generated by Phage Display," Molecular Biotechnology 54(2):269-277, Humana Press, United States (2013).
Narhi, L. O., et al., "Asn to Lys mutations at three sites which are N-glycosylated in the mammalian protein decrease the aggregation of *Escherichia coli*-derived erythropoietin," Protein Engineering 14(2):135-140, Oxford University Press, United Kingdom (2001).
Nieba, L., et al., "Disrupting the hydrophobic patches at the antibody variable/constant domain interface: improved in vivo folding and physical characterization of an engineered scFv fragment," Protein Engineering 10(4):534-444, Oxford University Press, United Kingdom (1997).
Nishimoto, N. and Kishimoto, T., "Interleukin 6: From Bench to Bedside," Nature Clinical Practice. Rheumatology 2(11):619-626, Nature Publishing Group, United States (2006).
Nishimoto, N., et al., "Humanized Anti-interleukin-6 Receptor Antibody Treatment of Multicentric Castleman Disease," Blood 106(8):2627-2632, American Society of Hematology, United States (2005).
Nohaile, M. J., et al., "Altering dimerization specificity by changes in surface electrostatics," PNAS 98(6):3109-3114 (2001).
Klein, C., et al., "Progress in overcoming the chain association issue in bispecific heterodimeric IgG antibodies," mAbs 4(6):653-663, Landes Bioscience, United States (2012).
O'Shea E. K., et al., "Peptide 'Velcro': design of a heterodimeric coiled coil," Current Biology 3:658-667 (1993).
Ozhegov et al., "Tolkovyi Slovar Russkogo iazyka," p. 292 (2004)(with English translation of the relevant passage defining "control").
Pakula, A.A. and Sauer, R.T., "Genetic Analysis of Protein Stability and Function," Annual Review of Genetics 23:289-310, Annual Reviews, United States (1989).

Pardridge, W.M., et al., "Enhanced Cellular Uptake and in Vivo Biodistribution of a Monoclonal Antibody Following Cationization," Journal of Pharmaceutical Sciences 84(8):943-948, Elsevier, United States (1995).
Pavlinkova, G., et al., "Charge-modified Single Chain Antibody Constructs of Monoclonal Antibody CC49: Generation, Characterization, Pharmacokinetics, and Biodistribution Analysis," Nuclear Medicine and Biology 26(1):27-34, Elsevier, United States (1999).
Pejchal, R., et al., "A Conformational Switch in Human Immunodeficiency Virus gp41 Revealed by the Structures of Overlapping Epitopes Recognized by Neutralizing Antibodies," Journal of Virology 83(17):8451-8462, American Society for Microbiology, United States (2009).
Pokkuluri, P. R., et al., "A domain flip as a result of a single amino-acid substitution," Structure 6:1067-1073 (1998).
Pons, J., et al., "Energetic Analysis of an Antigen/Antibody Interface: Alanine Scanning Mutagenesis and Double Mutant Cycles on the HyHEL-10/lysozyme Interaction," 3(5):958-968, Cold Spring Harbor Laboratory Press, United States (1999).
Presta, L.G., "Engineering of Therapeutic Antibodies to Minimize Immunogenicity and Optimize Function," Advanced Drug Delivery Reviews 58(5-6):640-656, Elsevier Science, Netherlands (2006).
Presta, L.G., "Molecular Engineering and Design of Therapeutic Antibodies," Current Opinion in Immunology 20(4):460-470, Elsevier, England (2008).
Raffen, R., et al., "Reengineering immunoglobulin domain interactions by introduction of charged residues," Protein Engineering 11(4):303-309, Oxford University Press, United Kingdom (1998).
Raposo, B., et al., "Epitope-specific antibody response is controlled by immunoglobulin $V_H$ polymorphisms," J. Exp. Med. 1-7, The Rockefeller University Press, United States (2014).
Reddy M.P., et al., "Elimination of Fc Receptor-Dependent Effector Functions of a Modified IgG4 Monoclonal Antibody to Human CD4," Journal of Immunology 164(4):1925-1933, American Association of Immunologists, United States (2000).
Reimann, K. A., et al., "A Humanized Form of a CD4-Specific Monoclonal Antibody Exhibits Decreased Antigenicity and Prolonged Plasma Half-Life in Rhesus Monkeys While Retaining Its Unique Biological and Antiviral Properties," Aids Research and Human Retroviruses 13(11):933-943, Mary Ann Liebert, Inc. (1997).
Rispens, T., et al., "Dynamics of Inter-heavy Chain Interactions in Human Immunoglobulin G (IgG) Subclasses Studied by Kinetic Fab Arm Exchange," J. Biol. Chem. 289(9):6098-6109, The American Society for Biochemistry and Molecular Biology, Inc., United States (2014).
Roitt et al.,Immunology, M., Mir.: pp. 110, 150, and 537-539 (2000)(in Russian, with what is believed to be a published English equivalent of those pages).
Roopenian, D.C. and Akilesh, S., "FcRn: The Neonatal Fc Receptor Comes of Age," Nature Reviews Immunology 7(9):715-725, Nature Publishing Group, England (Sep. 2007).
Rothe, A., et al., "Ribosome Display for Improved Biotherapeutic Molecules," Expert Opinion on Biological Therapy 6(2):177-187, Taylor & Francis, England (2006).
Ruf, P. and Lindhofer, H., "Induction of a long-lasting antitumor immunity by a trifunctional bispecific antibody," Blood 98(8):2526-2534 (2001).
Salfeld, J.G., "Isotype Selection in Antibody Engineering," Nature Biotechnology 25(12):1369-1372, Nature America Publishing, United States (2007).
Sal-Man, N., and Shai, Y., "Arginine mutations within a transmembrane of Tar, an *Escherichia coli* aspartate receptor, can drive homodimer dissociation and heterodimer association in vivo,", Biochem J. 1:29-36 (2005).
Sarkar, C.A., et al., "Rational Cytokine Design for Increased Lifetime and Enhanced Potency Using pH-activated Histidine Switching," Nature Biotechnology 20(9):908-913, Nature America Publishing, United States (2002).
Schaefer, W., et al., "Immunoglobulin domain crossover as a generic approach for the production of bispecific IgG antibodies," PNAS 108(27):11187-11192 (2011).

(56) References Cited

OTHER PUBLICATIONS

Schaeffer, R.C. Jr., et al., "The Rat Glomerular Filtration Barrier Does Not Show Negative Charge Selectivity," Microcirculation 9(5):329-342, Wiley-Blackwell, United States (2002).
Schmitz, U., et al., "Phage Display: a Molecular Tool for the Generation of Antibodies—a Review," Placenta 21 Suppl A:S106-S112, Elsevier, Netherlands (2000).
Schuurman, J., et al., "Normal human immunoglobulin G4 is bispecific: it has two different antigen-combining sites," Immunology 97:693-698, Blackwell Science Ltd., Netherlands (1999).
Schuurman, J., et al., "The inter-heavy chain disulfide bonds of IgG4 are in equilibrium with intra-chain disulfide bonds," Molecular Immunology 38:1-8, Elsevier Science Ltd., United Kingdom (2001).
Segal, D. M., et al., "Bispecific antibodies in cancer therapy," Cancer 558-562, Elsevier Science Ltd., United Kingdom (1999).
Sharifi, J., et al., "Improving monoclonal antibody pharmacokinetics via chemical modification," Q. J. Nucl. Med. 42:242-249 (1998).
Shire, S.J., et al., "Challenges in the Development of High Protein Concentration Formulations," Journal of Pharmaceutical Sciences 93(6):1390-1402, Elsevier, United States (2004).
Sinha, N., and Smith-Gill, S. J., "Electrostatics in Protein Binding and Function," Current Protein and Peptide Science 3:601-614 (2002).
Spiess, C., et al., "Bispecific antibodies with natural architecture produced by co-culture of bacteria expressing two distinct half-antibodies," Nature Biotechnology 31(8):753-759 (2013).
Strand, V., et al., "Biologic Therapies in Rheumatology: Lessons Learned, Future Directions," Nature Reviews Drug Discovery 6(1):75-92, Nature Publishing Group, England (2007).
Ströhlein, M. A., et al., "Induction of anti-tumor immunity by trifunctional antibodies in patients with peritoneal carcinomatosis," Journal of Experimental & Clinical Cancer Research 28(18):1-10, BioMed Central Ltd., Germany (2009).
Van Walle, I., et al., "Immunogenicity screening in protein drug development," Expert Opin. Biol. Ther. 7(3):405-418 (2007).
Tabrizi, M.A., et al., "Elimination Mechanisms of Therapeutic Monoclonal Antibodies," Drug Discovery Today 11(1-2):81-88, Virgin Mailing and Distribution, England (2006).
Tan, P.H., et al., "Engineering the Isoelectric Point of a Renal Cell Carcinoma Targeting Antibody Greatly Enhances scFV Solubility," Immunotechnology 4(2):107-114, Elsevier, Netherlands (1998).
Tan, P.H., et al., "Contributions of a Highly Conserved $V_H/V_L$ Hydrogen Bonding Interaction to scFv Folding Stabillity and Refolding Efficiency," Biophysical Journal 75:1473-1482, the Biophysical Society, United States (1998).
Tarditi, L., et al., "Selective High-performance Liquid Chromatographic Purification of Bispecific Monoclonal Antibodies," Journal of Chromatography 599(1-2):13-20, Elsevier, Netherlands (1992).
Teeling, J.L., et al., "The Biological Activity of Human CD20 Monoclonal Antibodies is Linked to Unique Epitopes on CD20," Journal of Immunology 177(1):362-371, American Association of Immunologists, United States (2006).
Teerinen, T., et al., "Structure-based Stability Engineering of the Mouse IgG1 Fab Fragment by Modifying Constant Domains," J. Mol. Biol. 361:687-697, Elsevier Ltd., United Kingdom (2006).
Ten Kate, C.I., et al., "Effect of Isoelectric Point on Biodistribution and Inflammation: Imaging With Indium-111-labelled IgG," European Journal of Nuclear Medicine 17(6-8):305-309, Springer Verlag, Germany (1990).
Thakur, A. and Lum, L. G., "Cancer therapy with bispecific antibodies: Clinical experience," Curr. Opin. Mol. Ther. 12(3):340-349 (2010).
Van Der Neut Kolfschoten, M., et al., "Anti-Inflammatory Activity of Human IgG4 Antibodies by Dynamic Fab Arm Exchange," Science 317(5844):1554-1557, (2007).
Van Walle, I., et al., "Immunogenicity Screening in Protein Drug Development," Expert Opinion on Biological Therapy 7(3):405-418, Taylor & Francis, Taylor & Francis (2007).

Vargas-Madrazo, E. and Paz-Garcia, E., "An improved model of association for VH-VL immunoglobulin domains: Asymmetries between VH and VL in the packing of some interface residues," J. Mol. Recognit. 16:113-120 (2003).
Verhoeyen, M., et al., "Re-shaped human anti-PLAP antibodies," Chapter 5, 37-43 in Monoclonal Antibodies: Applications in Clinical Oncology, A.A. Epenetos, Ed., Chapman and Hall (1991).
Verhoeyen, M.E., et al., "Construction of a reshaped HMFG1 antibody and comparison of its fine specificity with that of the parent mouse antibody," Immunology 78:364-370, Blackwell Scientific, England (1993).
Wang, N., et al., "Conserved amino acid networks involved in antibody variable domain interactions," Proteins 76:99-114 (2009).
Ward, E. S., et al., "Binding activities of a repertoire of single immunoglobulin variable domains secreted from *Escherichia coli*," Nature 341:544-546 (1989).
Ward, W. H. J., et al., "Effects of Engineering Complementary Charged Residues into the Hydrophobic Subunit Interface of Tyrosyl-tRNA Synthetase," Biochemistry 26:4131-4138 (1987).
Wiens, G.D., et al., "Somatic Mutation in VH Complementarity-determining Region 2 and Framework Region 2: Differential Effects on Antigen Binding and Ig Secretion," Journal of Immunology 159(3):1293-1302, American Association of Immunologists, United States (1997).
Wiens, G.D., et al., "Mutation of a Single Conserved Residue in VH Complementarity-determining Region 2 Results in a Severe Ig Secretion Defect," Journal of Immunology 167(4):2179-2186, American Association of Immunologists, United States (2001).
Wines, B. D., et al., "The IgG Fc Contains Distinct Fc Receptor (FcR) Binding Sites: The Leukocyte Receptors FcγRI and FcγRIIa Bind to a Region in the Fc Distinct from That Recognized by Neonatal FcR and Protein A," The Journal of Immunology 164:5313-5318 (2000).
Wolf, E., et al., "BiTEs: bispecific antibody constructs with unique anti-tumor activity," DDT 10(18): 1237-1244 (2005).
Wörn, A. and Plückthun, A., "Stability Engineering of Antibody Single-chain Fv Fragments," J. Mol. Biol. 305:989-1010 (2001).
Wu, A. M., et al., "Multimetization of a chimeric anti-CD20 single-chain Fv-Fc fusion protein is mediated through variable domain exchange," Protein Engineering 14(12):1025-1033 (2001).
Wu, H., et al., "Development of Motavizumab, an Ultra-potent Antibody for the Prevention of Respiratory Syncytial Virus Infection in the Upper and Lower Respiratory Tract," Journal of Molecular Biology 368(3):652-665, Academic Press, England (2007).
Xiang, J., et al., "Study of B72.3 Combining Sites by Molecular Modeling and Site-directed Mutagenesis," Protein Engineering 13(5):339-344, Oxford University Press, England (2000).
Yang, K., et al., "Tailoring Structure-function and Pharmacokinetic Properties of Single-chain Fv Proteins by Site-specific PEGylation," Protein Engineering 16(10):761-770, Oxford University Press, England (Oct. 2003).
Yang, W.P., et al., "CDR Walking Mutagenesis for the Affinity Maturation of a Potent Human Anti-HIV-1 Antibody into the Picomolar Range," Journal of Molecular Biology 254(3):392-403, Elsevier, England (Dec. 1995).
Zhu, Z., et al., "Remodeling domain interfaces to enhance heterodimer formation," Protein Science 6:781-788 (1997).
Zwick, M.B., et al., "The Long Third Complementarity-determining Region of the Heavy Chain Is Important in the Activity of the Broadly Neutralizing Anti-human Immunodeficiency Virus Type 1 Antibody 2F5," Journal of Virology 78(6):3155-3161, American Society for Microbiology, United States (2004).
Algonomics—TripoleR applications [Online] Retrieved from the Internet on Feb. 29, 2012, www.algonomics.com/proteinengineering/tripole_ applications.php, 2 pages (Feb. 21, 2009).
U.S. Appl. No. 15/782,256, co-pending related application.
U.S. Appl. No. 15/725,692, co-pending related application.
U.S. Appl. No. 15/562,186, co-pending related application.
Klinger, M., et al., "Harnessing T Cells to fight cancer with BiTE® antibody constructs—past developments and future directions," Immunol. Rev. 270(1):193-208 (2016).

(56) References Cited

OTHER PUBLICATIONS

Larkin, J., et al., "Combined Nivolumab and Ipilimumab or Monotherapy in Untreated Melanoma," N. Engl. J. Med. 373(1): 23-34 (2015).
Iwai, et al., "Therapeutic Agents for Gastric Cancer," Igan Chiryoyaku Yakkyoku 67(1):138-141 (2015), including English translation.
Buqué, A., et al., "Trial Watch: Immunomodulatory monoclonal antibodies for oncological indications," OncoImmunology 4(4): 16 pages. (2015).
U.S. Appl. No. 12/295,039, co-pending related application.
U.S. Appl. No. 12/679,922, co-pending related application.
U.S. Appl. No. 13/990,088, co-pending related application.
U.S. Appl. No. 14/741,786, co-pending related application.
U.S. Appl. No. 15/024,063, co-pending related application.
Nieba, L., et al., "Disrupting the hydrophobic patches at the antibody variable/constant domain interface: improved in vivo folding and physical characterization of an engineered scFv fragment," Protein Engineering 10(4):435-444, Oxford University Press, United Kingdom (1997).
Bowie, J. U., et al., "Deciphering the Message in Protein Sequences: Tolerance to Amino Acid Substitutions," Science, New Series, 247(4948):1306-1310 (1990).
Golay, J. and Introna, M., "Mechanism of action of therapeutic monoclonal antibodies: Promises and pitfalls of in vitro and in vivo assays," Archives of Biochemistry and Biophysics 526(2):146-153 (2012)(Abstract).
Hattori, K., "Introduction of ART-Ig and application to hemophilia A treatment," Chugai Pharmaceutical Co., Ltd., Information Meeting on Antibody Engineering Technologies Presentation 42-57 (Dec. 18, 2012).
Kumar, R., and Shieh, B., "The Second PDZ Doman of Inad Is a Type I Domain Involved in Binding to Eye Protein Kinase C," J Biol Chem 276(27):24971-24977 (2001).
Labrijn, A. F., et al., "Controlled Fab-arm exchange for the generation of stable bispecific IgG1," Nature Protocols 9(10):2450-2463 (2014).
U.S. Appl. No. 10/364,953, filed Feb. 11, 2003, related application.
Peters, S. J., et al., "Engineering an Improved IgG4 Molecule with Reduced Disulfide Bond Heterogeneity and Increased Fab Domain Thermal Stability," J Biol Chem 287(29):24525-24533 (2012).
Roitt, I., et al., "Antibody Structure and Function," Immunology 5th edition 80-81 (2000).
Stancovski, I., et al., "Mechanistic aspects of the opposing effects of monoclonal antibodies to the ERBB2 receptor on tumor growth," Proc Natl Acad Sci USA 88:8691-8695 (1991).
Suzuki, "Research and Development of Antibody Pharmaceuticals," NIBS Letter 56(4):45-51 (2010), with English translation.
U.S. Appl. No. 11/910,128, 371(c) filed Oct. 7, 2008, Igawa, T., related application.
Office Action dated Feb. 7, 2018 in U.S. Appl. No. 15/024,063, Igawa, T., filed Mar. 23, 2016.
Kim, D. Y., et al., "Antibody light chain variable domains and their biophysically improved versions for human immunotherapy," mAbs 6(1):219-235 (2014).
Kabat, E. A. and Wu, T. T., "Identical V Region Amino Acid Sequences and Segments of Sequences in Antibodies of Different Specificities," J Immunol 147(5):1709-1719 (1991).
Li, B., et al., "Framework selection can influence pharmacokinetics of a humanized therapeutic antibody through differences in molecule charge," mAbs 6(5):1255-1264 (2014).

\* cited by examiner

Fig. 1A  ERY22
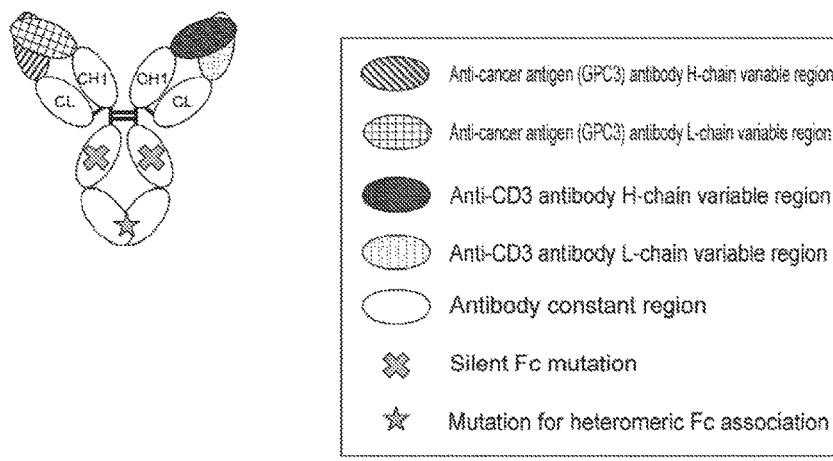
Fig. 1B  ERY27
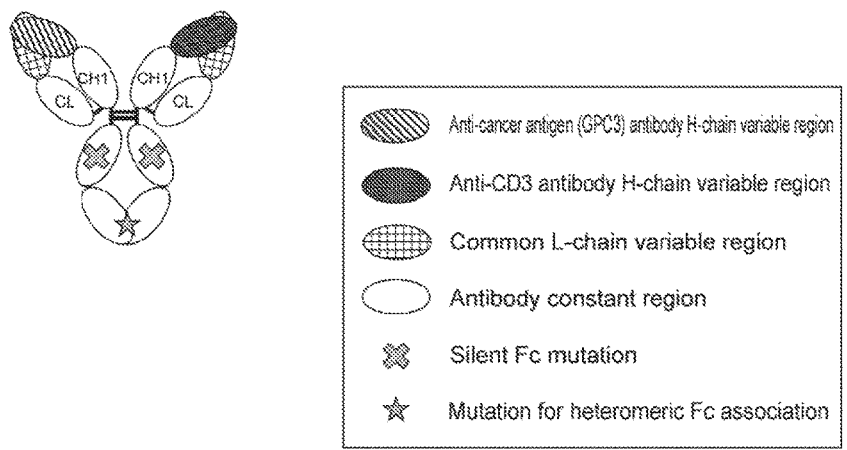

CYTOTOXICITY-INDUCING THERAPUTIC AGENT

CROSS-REFERENCE TO RELATED APPLICATIONS

This application is a continuation of International Application No. PCT/JP2015/077024, filed on Sep. 25, 2015, which claims the benefit of Japanese Application No. 2014-197315, filed on Sep. 26, 2014, the contents of which are hereby incorporated by reference in their entireties.

REFERENCE TO SEQUENCE LISTING SUBMITTED ELECTRONICALLY

The content of the electronically submitted sequence listing (Name: 3467_0180001_SeqListing.txt; Size: 619,301 bytes; and Date of Creation: Mar. 21, 2017) filed with the application is incorporated herein by reference in its entirety.

TECHNICAL FIELD

The present invention relates to multispecific antigen-binding molecules, uses thereof, and such.

BACKGROUND ART

Antibodies are drawing attention as pharmaceuticals because of their high stability in plasma and few adverse reactions (Non-patent Documents 1 and 2). Antibodies are known to induce not only an antigen-binding action, an agonistic action, and an antagonistic action, but also effector-mediated cytotoxic activities (also called effector functions) such as antibody-dependent cellular cytotoxicity (ADCC), antibody dependent cell phagocytosis (ADCP), and complement-dependent cytotoxicity (CDC), and exhibit antitumor effects against cancer cells (Non-Patent Document 3). ADCC is a cytotoxicity exhibited by effector cells against antibody-bound target cancer cells via binding of the antibody Fc region to an Fc receptor present on effector cells such as NK cells and macrophages. A complement complex binds to the complement-binding site present in an antibody structure. CDC is cell injury that results from cell destruction where an influx of water and ions into cells is promoted by pore formation on the cell membrane of the antibody-bound cells by complement components present in the complex. A number of therapeutic antibodies showing excellent anti-tumor effects have been developed as pharmaceuticals for cancer treatment (Non-patent Document 4); and while existing therapeutic antibodies have shown excellent actions, the therapeutic outcome achieved by administration of these antibodies is still not satisfactory.

For an antibody to express ADCC, ADCP, and CDC, it is necessary for the antibody Fc region, the antibody receptor (FcγR) present on effector cells such as NK cells and macrophages, and various complement components to bind. In humans, isoforms of FcγRIa, FcγRIIa, FcγRIIb, FcγRIIIa, and FcγRIIIb have been reported as the FcγR protein family, and the respective allotypes have been reported as well (Non-patent Document 5). Among these isoforms, FcγRIa, FcγRIIa, and FcγRIIIa carry a domain called the Immunoreceptor Tyrosine-based Activation Motif (ITAM) in the intracellular domain, and transmit activation signals. On the other hand, only FcγRIIb carries a domain called the Immunoreceptor Tyrosine-based Inhibitory Motif (ITIM) in the intracellular domain, and transmits inhibitory signals. Every one of the FcγRs is known to transmit signals via crosslinking by immune complexes and such (Non-patent Document 6). When antibodies actually exert an effector function on cancer cells, FcγRs on the effector cell membrane form clusters at the Fc regions of several antibodies bound on the cancer cell membrane, and activation signals are transmitted by effector cells. A cytocidal effect is exerted as a result, but since FcγRs are crosslinked only in effector cells present near cancer cells this time, activation of immunity is shown to occur locally in cancer cells (Non-patent Document 7).

Naturally-occurring immunoglobulins bind to antigens at their variable regions, and bind to receptors such as FcγR, FcRn, FcαR, and FcεR, and complements at their constant regions. FcRn is one of the binding molecules that interact at the IgG Fc region, and since each of the antibody heavy chains binds one molecule of FcRn, two molecules of FcRn have been reported to bind one IgG-type antibody molecule. However, unlike FcRn and such, FcγR interacts at the antibody hinge region and CH2 domain, and only one molecule of FcγR binds to one molecule of IgG-type antibody (Non-patent Document 8). Furthermore, a common naturally-occurring IgG-type antibody recognizes and binds a single epitope via its variable region (Fab); therefore, it can bind to only one antigen. On the other hand, many types of proteins are known to be involved in cancer and inflammation, and there may be crosstalk among the proteins. For example, several inflammatory cytokines (TNF, IL1 and IL6) are known to be involved in immunological diseases (Non-patent Document 9). Furthermore, activation of other receptors is known as one of the mechanisms of cancer in acquiring drug resistance (Non-patent Document 10). In such cases, common antibodies that recognize a single epitope would be unable to inhibit multiple proteins.

Antibodies (bispecific antibodies) that bind to two or more types of antigens with one molecule are being studied as molecules that inhibit multiple targets. It is possible to confer binding activities to two different antigens (a first antigen and a second antigen) by modifying naturally-occurring IgG-type antibodies (Non-patent Document 11). Accordingly, there will not only be neutralization of two or more types of antigens by a single molecule, but also enhancement of antitumor activity due to crosslinks between cells having cytotoxic activity and cancer cells. As molecular forms of a bispecific antibody, a molecule comprising an antigen-binding site added to the N or C terminus of an antibody (DVD-Ig and scFv-IgG), a molecule having different sequences for the two Fab regions of an antibody (common L-chain bispecific antibody and hybrid hybridoma), a molecule in which one Fab region recognizes two antigens (two-in-one IgG), and a molecule having a CH3 region loop site as a new antigen-binding site (Fcab) have been reported so far (Non-patent Documents 12 and 13). Since all bispecific antibodies interact at their Fc regions with FcγR, antibody effector functions are preserved. Thus, the bispecific antibody binds to any antigen that it recognizes and at the same time binds to FcγR, and exhibits ADCC activity against cells expressing the antigen.

If all the antigens recognized by the bispecific antibody are antigens specifically expressed in cancer, the bispecific antibody exhibits cytotoxic activity to cancer cells when it binds to any of the antigens. Therefore, in comparison to a conventional antibody pharmaceutical that recognizes one antigen, a more efficient antitumor effect can be expected from such an antibody. However, in the case where any one of the antigens recognized by the bispecific antibody is expressed in normal tissues or cells expressed on immunocytes, damage on normal tissues or release of cytokines occurs due to crosslinking with FcγR (Non-patent Document 14). As a result, strong adverse reactions are induced.

A T-cell redirecting antibody that employs cytotoxicity mobilizing T cells as effector cells as the mechanism for its antitumor effect has been known from the 1980s as a bispecific antibody (Non-patent Documents 15, 16, and 17). Unlike antibodies that employ ADCC mobilizing NK cells or macrophages as effector cells as the mechanism for their antitumor effects, a T-cell redirecting antibody is an antibody against any one of the subunits constituting the T-cell receptor (TCR) complex on T cells, and is specifically a bi-specific antibody comprising an antibody that binds to the CD3 epsilon chain and an antibody that binds to an antigen on the target cancer cell. T cells come close to cancer cells via simultaneous binding of the CD3 epsilon chain and a cancer antigen by a T-cell redirecting antibody. As a result, antitumor effects against cancer cells are considered to be exerted through the cytotoxic activity possessed by T cells.

Catumaxomab, which is known as a T-cell redirecting antibody, binds at two Fabs each to a cancer antigen (Ep-CAM) and to a CD3ε (CD3 epsilon) chain expressed on T cells. Catumaxomab induces T cell-mediated cytotoxic activity by binding to the cancer antigen and the CD3ε at the same time, and induces cytotoxic activity mediated by antigen-presenting cells such as NK cells and macrophages, by binding to the cancer antigen and FcγR at the same time. By use of these two cytotoxic activities, catumaxomab exhibits a high therapeutic effect on malignant ascites by intraperitoneal administration and has thus been approved in Europe (Non-patent Document 18). In addition, there are cases where the administration of catumaxomab reportedly yields cancer cell-reactive antibodies, which clearly shows that acquired immunity is induced (Non-patent Document 19). From this result, antibodies having both T cell-mediated cytotoxic activity and the FcγR-mediated actions by cells such as NK cells or macrophages (these antibodies are particularly referred to as trifunctional antibodies) have received attention because a strong antitumor effect and induction of acquired immunity can be expected.

The trifunctional antibodies, however, bind to CD3ε and FcγR at the same time even in the absence of a cancer antigen and therefore crosslink CD3ε-expressing T cells with FcγR-expressing cells even in a cancer cell-absent environment, leading to production of various cytokines in large amounts. Such cancer antigen-independent induction of production of various cytokines restricts the current administration of the trifunctional antibodies to an intraperitoneal route (Non-patent Document 20). The trifunctional antibodies are very difficult to administer systemically due to severe cytokine storm-like adverse reactions. In fact, in the Phase I clinical trial of administering catumaxomab systemically to non-small-cell lung cancer patients, a very low dose of 5 μg/body is the maximum permissible dose, and administration of a larger dose has been reported to cause various serious adverse reactions (Non-patent Document 21).

As such, bispecific antibodies by conventional techniques may bind to both antigens, the first antigen being the cancer antigen (EpCAM) and the second antigen being CD3ε, at the same time when they bind to FcγR; and therefore, in view of their molecular structure it is impossible to avoid adverse reactions caused by the simultaneous binding to FcγR and the second antigen CD3ε.

Meanwhile, unlike catumaxomab, BiTE has no Fcγ receptor-binding site, and therefore it does not cross-link the receptors expressed on T cells and cells such as NK cells and macrophages in a cancer antigen-dependent manner. Thus, it has been demonstrated that BiTE does not cause cancer antigen-independent cytokine induction which is observed when catumaxomab is administered. However, since BiTE is a modified low-molecular-weight antibody molecule without an Fc region, the problem is that its blood half-life after administration to a patient is significantly shorter than IgG-type antibodies conventionally used as therapeutic antibodies. In fact, the blood half-life of BiTE administered in vivo has been reported to be about several hours (Non-patent Documents 22 and 23). In the clinical trials of blinatumomab, it is administered by continuous intravenous infusion using a minipump. This administration method is not only extremely inconvenient for patients but also has the potential risk of medical accidents due to device malfunction or the like. Thus, it cannot be said that such an administration method is desirable.

In recent years, use of an Fc region with reduced FcγR-binding activity has enabled maintenance of the strong antitumor activity possessed by BiTE and the excellent safety property of not inducing a cytokine storm in a cancer antigen-dependent manner, and has provided novel polypeptide assemblies that have long half-lives in blood (Patent Document 1).

On the other hand, when expressing a bispecific antibody by conventional techniques, since two types of H chains and two types of L chains are expressed, ten combinations are conceivable. Among them, only one of the produced combinations has the binding specificity of interest. Therefore, to obtain the bispecific antibody of interest, the single antibody of interest must be purified from the ten types of antibodies, which is very inefficient and difficult.

A method of preferentially secreting IgGs with a heterodimeric combination of H chains, for example, a combination of an H chain against antigen A and an H chain against antigen B, by introducing amino acid substitutions into the IgG H-chain CH3 region has been reported as a method for solving this problem (Patent Documents 2, 3, 4, 5, 6, 7, and Non-patent Documents 24 and 25). A method that utilizes physical disturbance, i.e., "knob" and "hole", and a method that utilizes electric charge repulsion have been reported as such methods.

To obtain the molecule of interest with better efficiency, methods using L chains that can bind to two different antigens even though the L chains have the same amino acid sequence have been reported (Patent Documents 8 and 9). However, the antigen affinity may decrease greatly with the use of common L chains, and it is difficult to find common L chains that maintain antigen affinity.

CITATION LIST

Patent Documents

[Patent Document 1] WO 2012/073985; [Patent Document 2] WO 1996/27011; [Patent Document 3] WO 2006/106905; [Patent Document 4] WO 2007/147901; [Patent Document 5] WO 2009/089004; [Patent Document 6] WO 2010/129304; [Patent Document 7] WO 2013/065708; [Patent Document 8] WO 1998/050431; [Patent Document 9] WO 2006/109592

Non-Patent Documents

[Non-patent Document 1] Nat. Biotechnol. (2005) 23, 1073-1078; [Non-patent Document 2] Eur J Pharm Biopharm. (2005) 59 (3), 389-396; [Non-patent Document 3] Drug Des Devel Ther (2009) 3, 7-16; [Non-patent Document 4]

Clin Cancer Res. (2010) 16 (1), 11-20; [Non-patent Document 5] Immunol. Lett. (2002) 82, 57-65; [Non-patent Document 6] Nat. Rev. Immunol. (2008) 8, 34-47; [Non-patent Document 7] Ann. Rev. Immunol. (1988). 6. 251-81; [Non-patent Document 8] J. Bio. Chem., (20001) 276, 16469-16477; [Non-patent Document 9] Nat. Biotech., (2011) 28, 502-10; [Non-patent Document 10] Endocr Relat Cancer (2006) 13, 45-51; [Non-patent Document 11] MAbs. (2012) March 1, 4(2); [Non-patent Document 12] Nat. Rev. (2010) 10, 301-316; [Non-patent Document 13] Peds (2010), 23(4), 289-297; [Non-patent Document 14] J. Immunol. (1999) August 1, 163(3), 1246-52; [Non-patent Document 15] Nature (1985) 314 (6012), 628-31; [Non-patent Document 16] Int J Cancer (1988) 41 (4), 609-15; [Non-patent Document 17] Proc Natl Acad Sci USA (1986) 83 (5), 1453-7; [Non-patent Document 18] Cancer Treat Rev. (2010) October 36(6), 458-67; [Non-patent Document 19] Future Oncol. (2012) January 8(1), 73-85; [Non-patent Document 20] Cancer Immunol Immunother. (2007) 56(9), 1397-406; [Non-patent Document 21] Cancer Immunol Immunother. (2007) 56 (10), 1637-44; [Non-patent Document 22] Cancer Immunol Immunother. (2006) 55(5), 503-14; [Non-patent Document 23] Cancer Immunol Immunother. (2009) 58(1), 95-109; [Non-patent Document 24] Protein Engineering. (1996) vol. 9, p. 617-621; [Non-patent Document 25] Nature Biotechnology. (1998) vol. 16, p. 677-681

SUMMARY OF THE INVENTION

Problems to be Solved by the Invention

The present invention was achieved in view of the above circumstances. An objective of the present invention is to provide multispecific antigen-binding molecules that bring T cells close to the target cancer cells, and can treat cancer through the cytotoxic activity of T cells against target cancer tissues containing glypican 3-expressing cells, and are molecular forms that can be produced with high efficiency; methods for producing the antigen-binding molecules; and pharmaceutical compositions comprising the antigen-binding molecules as active ingredient.

Means for Solving the Problems

The present inventors discovered an L chain common to a domain comprising a glypican 3-binding antibody variable region, and a domain comprising a T-cell receptor complex-binding antibody variable region, where the common L chain is capable of improving affinity to both antigens. This allows preparation of molecular forms that can be produced with high efficiency, and further discovery of novel multi-specific antigen-binding molecules that maintain the strong antitumor activity possessed by T-cell redirecting antibodies such as BiTE and the excellent safety property of not inducing a cytokine storm in a cancer antigen-dependent manner, and also have long half-lives in blood. Furthermore, the present inventors discovered that the multispecific antigen-binding molecules comprising common L chains target glypican 3-expressing cancer cells and cause cell injury. Based on this discovery, the present inventors elucidated that the multispecific antigen-binding molecules of the present invention cause injury to cancer tissues containing glypican 3-expressing cancer cells.

More specifically, the present invention provides the following:

[1] A multispecific antigen-binding molecule that comprises:
   (1) a domain comprising an antibody variable region having glypican 3-binding activity,
   (2) a domain comprising an antibody variable region having T-cell receptor complex-binding activity, and
   (3) a domain comprising an Fc region with reduced binding activity towards an Fcγ receptor,
wherein the L chain variable regions comprised in the variable region of (1) and the variable region of (2) have a common amino acid sequence; wherein the multispecific antigen-binding molecule has a cytotoxic activity equivalent to or greater than that of the bispecific antibody GPC3_ERY22_rCE115 comprising a glypican 3-binding domain comprising SEQ ID NOs: 47 and 48, and a T-cell receptor complex-binding domain comprising SEQ ID NOs: 49 and 50.

[2] The multispecific antigen-binding molecule of [1], wherein the cytotoxic activity is T-cell-dependent cytotoxic activity.

[3] The multispecific antigen-binding molecule of [1] or [2], wherein the T-cell receptor complex-binding activity is binding activity towards a T-cell receptor.

[4] The multispecific antigen-binding molecule of any one of [1] to [3], wherein the T-cell receptor complex-binding activity is binding activity towards a CD3ε chain.

[5] The multispecific antigen-binding molecule of any one of [1] to [4], wherein the antibody variable region of (1) in [1] is an antibody variable region that comprises any one of the combinations of H-chain CDR1, CDR2, and CDR3 selected from (a1) to (a5) below, or an antibody variable region functionally equivalent thereto:
   (a1) CDR1, CDR2, and CDR3 identical to the amino acid sequences of the CDR1, CDR2, and CDR3 regions comprised in SEQ ID NO:40;
   (a2) CDR1, CDR2, and CDR3 identical to the amino acid sequences of the CDR1, CDR2, and CDR3 regions comprised in SEQ ID NO:197;
   (a3) CDR1, CDR2, and CDR3 identical to the amino acid sequences of the CDR1, CDR2, and CDR3 regions comprised in SEQ ID NO:206;
   (a4) CDR1, CDR2, and CDR3 identical to the amino acid sequences of the CDR1, CDR2, and CDR3 regions comprised in SEQ ID NO:211; and
   (a5) CDR1, CDR2, and CDR3 identical to the amino acid sequences of the CDR1, CDR2, and CDR3 regions comprised in SEQ ID NO:215.

[6] The multispecific antigen-binding molecule of any one of [1] to [4], wherein the antibody variable region of (2) in [1] is an antibody variable region that comprises any one of the combinations of H-chain CDR1, CDR2, and CDR3 amino acid sequences selected from (b1) to (b15) below, or an antibody variable region functionally equivalent thereto:
   (b1) CDR1, CDR2, and CDR3 identical to the amino acid sequences of the CDR1, CDR2, and CDR3 regions comprised in SEQ ID NO:52;
   (b2) CDR1, CDR2, and CDR3 identical to the amino acid sequences of the CDR1, CDR2, and CDR3 regions comprised in SEQ ID NO:103;
   (b3) CDR1, CDR2, and CDR3 identical to the amino acid sequences of the CDR1, CDR2, and CDR3 regions comprised in SEQ ID NO:122;

(b4) CDR1, CDR2, and CDR3 identical to the amino acid sequences of the CDR1, CDR2, and CDR3 regions comprised in SEQ ID NO:128;
(b5) CDR1, CDR2, and CDR3 identical to the amino acid sequences of the CDR1, CDR2, and CDR3 regions comprised in SEQ ID NO:129;
(b6) CDR1, CDR2, and CDR3 identical to the amino acid sequences of the CDR1, CDR2, and CDR3 regions comprised in SEQ ID NO:132;
(b7) CDR1, CDR2, and CDR3 identical to the amino acid sequences of the CDR1, CDR2, and CDR3 regions comprised in SEQ ID NO:142;
(b8) CDR1, CDR2, and CDR3 identical to the amino acid sequences of the CDR1, CDR2, and CDR3 regions comprised in SEQ ID NO:144;
(b9) CDR1, CDR2, and CDR3 identical to the amino acid sequences of the CDR1, CDR2, and CDR3 regions comprised in SEQ ID NO:164;
(b10) CDR1, CDR2, and CDR3 identical to the amino acid sequences of the CDR1, CDR2, and CDR3 regions comprised in SEQ ID NO:168;
(b11) CDR1, CDR2, and CDR3 identical to the amino acid sequences of the CDR1, CDR2, and CDR3 regions comprised in SEQ ID NO:421;
(b12) CDR1, CDR2, and CDR3 identical to the amino acid sequences of the CDR1, CDR2, and CDR3 regions comprised in SEQ ID NO:424;
(b13) CDR1, CDR2, and CDR3 identical to the amino acid sequences of the CDR1, CDR2, and CDR3 regions comprised in SEQ ID NO:426;
(b14) CDR1, CDR2, and CDR3 identical to the amino acid sequences of the CDR1, CDR2, and CDR3 regions comprised in SEQ ID NO:429; and
(b15) CDR1, CDR2, and CDR3 identical to the amino acid sequences of the CDR1, CDR2, and CDR3 regions comprised in SEQ ID NO:430.

[7] The multispecific antigen-binding molecule of any one of [1] to [4], wherein the antibody variable regions of (1) and (2) in [1] are antibody variable regions comprising any one of the combinations of H-chain CDR1, CDR2, and CDR3 selected from the following (c1) to (c19), or antibody variable regions functionally equivalent thereto:
(c1) CDR1, CDR2, and CDR3 comprised in the antibody variable region of (1) in [1] and identical to the amino acid sequences of the CDR1, CDR2, and CDR3 regions comprised in SEQ ID NO:40; and CDR1, CDR2, and CDR3 comprised in the antibody variable region of (2) in [1] and identical to the amino acid sequences of the CDR1, CDR2, and CDR3 regions comprised in SEQ ID NO:52;
(c2) CDR1, CDR2, and CDR3 comprised in the antibody variable region of (1) in [1] and identical to the amino acid sequences of the CDR1, CDR2, and CDR3 regions comprised in SEQ ID NO:40; and CDR1, CDR2, and CDR3 comprised in the antibody variable region of (2) in [1] and identical to the amino acid sequences of the CDR1, CDR2, and CDR3 regions comprised in SEQ ID NO:421;
(c3) CDR1, CDR2, and CDR3 comprised in the antibody variable region of (1) in [1] and identical to the amino acid sequences of the CDR1, CDR2, and CDR3 regions comprised in SEQ ID NO:40; and CDR1, CDR2, and CDR3 comprised in the antibody variable region of (2) in [1] and identical to the amino acid sequences of the CDR1, CDR2, and CDR3 regions comprised in SEQ ID NO:426;
(c4) CDR1, CDR2, and CDR3 comprised in the antibody variable region of (1) in [1] and identical to the amino acid sequences of the CDR1, CDR2, and CDR3 regions comprised in SEQ ID NO:40; and CDR1, CDR2, and CDR3 comprised in the antibody variable region of (2) in [1] and identical to the amino acid sequences of the CDR1, CDR2, and CDR3 regions comprised in SEQ ID NO:429;
(c5) CDR1, CDR2, and CDR3 comprised in the antibody variable region of (1) in [1] and identical to the amino acid sequences of the CDR1, CDR2, and CDR3 regions comprised in SEQ ID NO:40; and CDR1, CDR2, and CDR3 comprised in the antibody variable region of (2) in [1] and identical to the amino acid sequences of the CDR1, CDR2, and CDR3 regions comprised in SEQ ID NO:430;
(c6) CDR1, CDR2, and CDR3 comprised in the antibody variable region of (1) in [1] and identical to the amino acid sequences of the CDR1, CDR2, and CDR3 regions comprised in SEQ ID NO:197; and CDR1, CDR2, and CDR3 comprised in the antibody variable region of (2) in [1] and identical to the amino acid sequences of the CDR1, CDR2, and CDR3 regions comprised in SEQ ID NO:128;
(c7) CDR1, CDR2, and CDR3 comprised in the antibody variable region of (1) in [1] and identical to the amino acid sequences of the CDR1, CDR2, and CDR3 regions comprised in SEQ ID NO:206; and CDR1, CDR2, and CDR3 comprised in the antibody variable region of (2) in [1] and identical to the amino acid sequences of the CDR1, CDR2, and CDR3 regions comprised in SEQ ID NO:142;
(c8) CDR1, CDR2, and CDR3 comprised in the antibody variable region of (1) in [1] and identical to the amino acid sequences of the CDR1, CDR2, and CDR3 regions comprised in SEQ ID NO:206; and CDR1, CDR2, and CDR3 comprised in the antibody variable region of (2) in [1] and identical to the amino acid sequences of the CDR1, CDR2, and CDR3 regions comprised in SEQ ID NO:144;
(c9) CDR1, CDR2, and CDR3 comprised in the antibody variable region of (1) in [1] and identical to the amino acid sequences of the CDR1, CDR2, and CDR3 regions comprised in SEQ ID NO:206; and CDR1, CDR2, and CDR3 comprised in the antibody variable region of (2) in [1] and identical to the amino acid sequences of the CDR1, CDR2, and CDR3 regions comprised in SEQ ID NO:164;
(c10) CDR1, CDR2, and CDR3 comprised in the antibody variable region of (1) in [1] and identical to the amino acid sequences of the CDR1, CDR2, and CDR3 regions comprised in SEQ ID NO:206; and CDR1, CDR2, and CDR3 comprised in the antibody variable region of (2) in [1] and identical to the amino acid sequences of the CDR1, CDR2, and CDR3 regions comprised in SEQ ID NO:168;
(c11) CDR1, CDR2, and CDR3 comprised in the antibody variable region of (1) in [1] and identical to the amino acid sequences of the CDR1, CDR2, and CDR3 regions comprised in SEQ ID NO:211; and CDR1, CDR2, and CDR3 comprised in the antibody variable region of (2) in [1] and identical to the amino acid sequences of the CDR1, CDR2, and CDR3 regions comprised in SEQ ID NO:142;
(c12) CDR1, CDR2, and CDR3 comprised in the antibody variable region of (1) in [1] and identical to the amino acid sequences of the CDR1, CDR2, and CDR3 regions comprised in SEQ ID NO:211; and CDR1, CDR2, and CDR3 comprised in the antibody variable region of (2) in [1] and identical to the amino acid sequences of the CDR1, CDR2, and CDR3 regions comprised in SEQ ID NO:144;

(c13) CDR1, CDR2, and CDR3 comprised in the antibody variable region of (1) in [1] and identical to the amino acid sequences of the CDR1, CDR2, and CDR3 regions comprised in SEQ ID NO:211; and CDR1, CDR2, and CDR3 comprised in the antibody variable region of (2) in [1] and identical to the amino acid sequences of the CDR1, CDR2, and CDR3 regions comprised in SEQ ID NO:164;

(c14) CDR1, CDR2, and CDR3 comprised in the antibody variable region of (1) in [1] and identical to the amino acid sequences of the CDR1, CDR2, and CDR3 regions comprised in SEQ ID NO:211; and CDR1, CDR2, and CDR3 comprised in the antibody variable region of (2) in [1] and identical to the amino acid sequences of the CDR1, CDR2, and CDR3 regions comprised in SEQ ID NO:168;

(c15) CDR1, CDR2, and CDR3 comprised in the antibody variable region of (1) in [1] and identical to the amino acid sequences of the CDR1, CDR2, and CDR3 regions comprised in SEQ ID NO:215; and CDR1, CDR2, and CDR3 comprised in the antibody variable region of (2) in [1] and identical to the amino acid sequences of the CDR1, CDR2, and CDR3 regions comprised in SEQ ID NO:103;

(c16) CDR1, CDR2, and CDR3 comprised in the antibody variable region of (1) in [1] and identical to the amino acid sequences of the CDR1, CDR2, and CDR3 regions comprised in SEQ ID NO:215; and CDR1, CDR2, and CDR3 comprised in the antibody variable region of (2) in [1] and identical to the amino acid sequences of the CDR1, CDR2, and CDR3 regions comprised in SEQ ID NO:122;

(c17) CDR1, CDR2, and CDR3 comprised in the antibody variable region of (1) in [1] and identical to the amino acid sequences of the CDR1, CDR2, and CDR3 regions comprised in SEQ ID NO:215; and CDR1, CDR2, and CDR3 comprised in the antibody variable region of (2) in [1] and identical to the amino acid sequences of the CDR1, CDR2, and CDR3 regions comprised in SEQ ID NO:129;

(c18) CDR1, CDR2, and CDR3 comprised in the antibody variable region of (1) in [1] and identical to the amino acid sequences of the CDR1, CDR2, and CDR3 regions comprised in SEQ ID NO:215; and CDR1, CDR2, and CDR3 comprised in the antibody variable region of (2) in [1] and identical to the amino acid sequences of the CDR1, CDR2, and CDR3 regions comprised in SEQ ID NO:132; and (c19) CDR1, CDR2, and CDR3 comprised in the antibody variable region of (1) in [1] and identical to the amino acid sequences of the CDR1, CDR2, and CDR3 regions comprised in SEQ ID NO:215; and CDR1, CDR2, and CDR3 comprised in the antibody variable region of (2) in [1] and identical to the amino acid sequences of the CDR1, CDR2, and CDR3 regions comprised in SEQ ID NO:424.

[8] The multispecific antigen-binding molecule of any one of [5] to [7], wherein CDR1, CDR2, and CDR3 are CDR1, CDR2, and CDR3 regions based on Kabat numbering.

[9] The multispecific antigen-binding molecule of any one of [1] to [4], wherein the antibody variable region of (1) in [1] is an antibody variable region comprising any one of the H-chain variable regions selected from (a1) to (a5) below, or an antibody variable region functionally equivalent thereto:
(a1) an H-chain variable region having the amino acid sequence of SEQ ID NO:40;
(a2) an H-chain variable region having the amino acid sequence of SEQ ID NO:197;
(a3) an H-chain variable region having the amino acid sequence of SEQ ID NO:206;
(a4) an H-chain variable region having the amino acid sequence of SEQ ID NO:211; and
(a5) an H-chain variable region having the amino acid sequence of SEQ ID NO:215.

[10] The multispecific antigen-binding molecule of any one of [1] to [4], wherein the antibody variable region of (2) in [1] is an antibody variable region comprising any one of the H-chain variable regions selected from (b1) to (b15) below, or an antibody variable region functionally equivalent thereto:
(b1) an H-chain variable region having the amino acid sequence of SEQ ID NO:52;
(b2) an H-chain variable region having the amino acid sequence of SEQ ID NO:103;
(b3) an H-chain variable region having the amino acid sequence of SEQ ID NO:122;
(b4) an H-chain variable region having the amino acid sequence of SEQ ID NO:128;
(b5) an H-chain variable region having the amino acid sequence of SEQ ID NO:129;
(b6) an H-chain variable region having the amino acid sequence of SEQ ID NO:132;
(b7) an H-chain variable region having the amino acid sequence of SEQ ID NO:142;
(b8) an H-chain variable region having the amino acid sequence of SEQ ID NO:144;
(b9) an H-chain variable region having the amino acid sequence of SEQ ID NO:164;
(b10) an H-chain variable region having the amino acid sequence of SEQ ID NO:168;
(b11) an H-chain variable region having the amino acid sequence of SEQ ID NO:421;
(b12) an H-chain variable region having the amino acid sequence of SEQ ID NO:424;
(b13) an H-chain variable region having the amino acid sequence of SEQ ID NO:426;
(b14) an H-chain variable region having the amino acid sequence of SEQ ID NO:429; and
(b15) an H-chain variable region having the amino acid sequence of SEQ ID NO:430.

[11] The multispecific antigen-binding molecule of any one of [1] to [4], wherein the antibody variable regions of (1) and (2) in [1] are antibody variable regions comprising any one of the combinations of H-chain variable regions selected from (c1) to (c19) below, or antibody variable regions functionally equivalent thereto:
(c1) an H-chain variable region comprised in the antibody variable region of (1) in [1] which has the amino acid sequence of SEQ ID NO:40; and an H-chain variable region comprised in the antibody variable region of (2) in [1] which has the amino acid sequence of SEQ ID NO:52;

(c2) an H-chain variable region comprised in the antibody variable region of (1) in [1] which has the amino acid sequence of SEQ ID NO:40; and an H-chain variable region comprised in the antibody variable region of (2) in [1] which has the amino acid sequence of SEQ ID NO:421;

(c3) an H-chain variable region comprised in the antibody variable region of (1) in [1] which has the amino acid sequence of SEQ ID NO:40; and an H-chain variable region comprised in the antibody variable region of (2) in [1] which has the amino acid sequence of SEQ ID NO:426;

(c4) an H-chain variable region comprised in the antibody variable region of (1) in [1] which has the amino acid sequence of SEQ ID NO:40; and an H-chain variable region comprised in the antibody variable region of (2) in [1] which has the amino acid sequence of SEQ ID NO:429;

(c5) an H-chain variable region comprised in the antibody variable region of (1) in [1] which has the amino acid sequence of SEQ ID NO:40; and an H-chain variable region comprised in the antibody variable region of (2) in [1] which has the amino acid sequence of SEQ ID NO:430;

(c6) an H-chain variable region comprised in the antibody variable region of (1) in [1] which has the amino acid sequence of SEQ ID NO:197; and an H-chain variable region comprised in the antibody variable region of (2) in [1] which has the amino acid sequence of SEQ ID NO:128;

(c7) an H-chain variable region comprised in the antibody variable region of (1) in [1] which has the amino acid sequence of SEQ ID NO:206; and an H-chain variable region comprised in the antibody variable region of (2) in [1] which has the amino acid sequence of SEQ ID NO:142;

(c8) an H-chain variable region comprised in the antibody variable region of (1) in [1] which has the amino acid sequence of SEQ ID NO:206; and an H-chain variable region comprised in the antibody variable region of (2) in [1] which has the amino acid sequence of SEQ ID NO:144;

(c9) an H-chain variable region comprised in the antibody variable region of (1) in [1] which has the amino acid sequence of SEQ ID NO:206; and an H-chain variable region comprised in the antibody variable region of (2) in [1] which has the amino acid sequence of SEQ ID NO:164;

(c10) an H-chain variable region comprised in the antibody variable region of (1) in [1] which has the amino acid sequence of SEQ ID NO:206; and an H-chain variable region comprised in the antibody variable region of (2) in [1] which has the amino acid sequence of SEQ ID NO:168;

(c11) an H-chain variable region comprised in the antibody variable region of (1) in [1] which has the amino acid sequence of SEQ ID NO:211; and an H-chain variable region comprised in the antibody variable region of (2) in [1] which has the amino acid sequence of SEQ ID NO:142;

(c12) an H-chain variable region comprised in the antibody variable region of (1) in [1] which has the amino acid sequence of SEQ ID NO:211; and an H-chain variable region comprised in the antibody variable region of (2) in [1] which has the amino acid sequence of SEQ ID NO:144;

(c13) an H-chain variable region comprised in the antibody variable region of (1) in [1] which has the amino acid sequence of SEQ ID NO:211; and an H-chain variable region comprised in the antibody variable region of (2) in [1] which has the amino acid sequence of SEQ ID NO:164;

(c14) an H-chain variable region comprised in the antibody variable region of (1) in [1] which has the amino acid sequence of SEQ ID NO:211; and an H-chain variable region comprised in the antibody variable region of (2) in [1] which has the amino acid sequence of SEQ ID NO:168;

(c15) an H-chain variable region comprised in the antibody variable region of (1) in [1] which has the amino acid sequence of SEQ ID NO:215; and an H-chain variable region comprised in the antibody variable region of (2) in [1] which has the amino acid sequence of SEQ ID NO:103;

(c16) an H-chain variable region comprised in the antibody variable region of (1) in [1] which has the amino acid sequence of SEQ ID NO:215; and an H-chain variable region comprised in the antibody variable region of (2) in [1] which has the amino acid sequence of SEQ ID NO:122;

(c17) an H-chain variable region comprised in the antibody variable region of (1) in [1] which has the amino acid sequence of SEQ ID NO:215; and an H-chain variable region comprised in the antibody variable region of (2) in [1] which has the amino acid sequence of SEQ ID NO:129;

(c18) an H-chain variable region comprised in the antibody variable region of (1) in [1] which has the amino acid sequence of SEQ ID NO:215; and an H-chain variable region comprised in the antibody variable region of (2) in [1] which has the amino acid sequence of SEQ ID NO:132; and (c19) an H-chain variable region comprised in the antibody variable region of (1) in [1] which has the amino acid sequence of SEQ ID NO:215; and an H-chain variable region comprised in the antibody variable region of (2) in [1] which has the amino acid sequence of SEQ ID NO:424.

[12] The multispecific antigen-binding molecule of any one of [1] to [11], wherein the common L chain of [1] is a common L chain comprising any one of the combinations of CDR1, CDR2, and CDR3 selected from (d1) to (d11) below, or a common L chain functionally equivalent thereto:

(d1) CDR1, CDR2, and CDR3 identical to the amino acid sequences of the CDR1, CDR2, and CDR3 regions comprised in SEQ ID NO:53;

(d2) CDR1, CDR2, and CDR3 identical to the amino acid sequences of the CDR1, CDR2, and CDR3 regions comprised in SEQ ID NO:223;

(d3) CDR1, CDR2, and CDR3 identical to the amino acid sequences of the CDR1, CDR2, and CDR3 regions comprised in SEQ ID NO:299;

(d4) CDR1, CDR2, and CDR3 identical to the amino acid sequences of the CDR1, CDR2, and CDR3 regions comprised in SEQ ID NO:301;

(d5) CDR1, CDR2, and CDR3 identical to the amino acid sequences of the CDR1, CDR2, and CDR3 regions comprised in SEQ ID NO:302;

(d6) CDR1, CDR2, and CDR3 identical to the amino acid sequences of the CDR1, CDR2, and CDR3 regions comprised in SEQ ID NO:304;

(d7) CDR1, CDR2, and CDR3 identical to the amino acid sequences of the CDR1, CDR2, and CDR3 regions comprised in SEQ ID NO:306;
(d8) CDR1, CDR2, and CDR3 identical to the amino acid sequences of the CDR1, CDR2, and CDR3 regions comprised in SEQ ID NO:307;
(d9) CDR1, CDR2, and CDR3 identical to the amino acid sequences of the CDR1, CDR2, and CDR3 regions comprised in SEQ ID NO:309;
(d10) CDR1, CDR2, and CDR3 identical to the amino acid sequences of the CDR1, CDR2, and CDR3 regions comprised in SEQ ID NO:310; and
(d11) CDR1, CDR2, and CDR3 identical to the amino acid sequences of the CDR1, CDR2, and CDR3 regions comprised in SEQ ID NO:319.

[13] The multispecific antigen-binding molecule of any one of [1] to [11], wherein the L chain variable region of [1] is a variable region of any one of the L chain amino acid sequences selected from (d1) to (d11) below:
(d1) an L chain comprising the amino acid sequence of SEQ ID NO:53;
(d2) an L chain comprising the amino acid sequence of SEQ ID NO:223;
(d3) an L chain comprising the amino acid sequence of SEQ ID NO:299;
(d4) an L chain comprising the amino acid sequence of SEQ ID NO:301;
(d5) an L chain comprising the amino acid sequence of SEQ ID NO:302;
(d6) an L chain comprising the amino acid sequence of SEQ ID NO:304;
(d7) an L chain comprising the amino acid sequence of SEQ ID NO:306;
(d8) an L chain comprising the amino acid sequence of SEQ ID NO:307;
(d9) an L chain comprising the amino acid sequence of SEQ ID NO:309;
(d10) an L chain comprising the amino acid sequence of SEQ ID NO:310; and
(d11) an L chain comprising the amino acid sequence of SEQ ID NO:319.

[14] The multispecific antigen-binding molecule of any one of [1] to [4], wherein the antibody variable regions of (1) and (2) of [1] and the common L chain variable region are antibody variable regions comprising any one of the combinations of H-chain CDR1, CDR2, and CDR3 and L-chain CDR1, CDR2, and CDR3 selected from (e1) to (e25) below, or antibody variable regions functionally equivalent thereto:
(e1) CDR1, CDR2, and CDR3 comprised in the antibody variable region of (1) in [1] and identical to the amino acid sequences of the CDR1, CDR2, and CDR3 regions comprised in SEQ ID NO:197; CDR1, CDR2, and CDR3 comprised in the antibody variable region of (2) in [1] and identical to the amino acid sequences of the CDR1, CDR2, and CDR3 regions comprised in SEQ ID NO:128; and CDR1, CDR2, and CDR3 comprised in the antibody variable region of the common L chain and identical to the amino acid sequences of the CDR1, CDR2, and CDR3 regions comprised in SEQ ID NO:53;
(e2) CDR1, CDR2, and CDR3 comprised in the antibody variable region of (1) in [1] and identical to the amino acid sequences of the CDR1, CDR2, and CDR3 regions comprised in SEQ ID NO:197; CDR1, CDR2, and CDR3 comprised in the antibody variable region of (2) in [1] and identical to the amino acid sequences of the CDR1, CDR2, and CDR3 regions comprised in SEQ ID NO:128; and CDR1, CDR2, and CDR3 comprised in the antibody variable region of the common L chain and identical to the amino acid sequences of the CDR1, CDR2, and CDR3 regions comprised in SEQ ID NO:299;
(e3) CDR1, CDR2, and CDR3 comprised in the antibody variable region of (1) in [1] and identical to the amino acid sequences of the CDR1, CDR2, and CDR3 regions comprised in SEQ ID NO:197; CDR1, CDR2, and CDR3 comprised in the antibody variable region of (2) in [1] and identical to the amino acid sequences of the CDR1, CDR2, and CDR3 regions comprised in SEQ ID NO:128; and CDR1, CDR2, and CDR3 comprised in the antibody variable region of the common L chain and identical to the amino acid sequences of the CDR1, CDR2, and CDR3 regions comprised in SEQ ID NO:310;
(e4) CDR1, CDR2, and CDR3 comprised in the antibody variable region of (1) in [1] and identical to the amino acid sequences of the CDR1, CDR2, and CDR3 regions comprised in SEQ ID NO:197; CDR1, CDR2, and CDR3 comprised in the antibody variable region of (2) in [1] and identical to the amino acid sequences of the CDR1, CDR2, and CDR3 regions comprised in SEQ ID NO:128; and CDR1, CDR2, and CDR3 comprised in the antibody variable region of the common L chain and identical to the amino acid sequences of the CDR1, CDR2, and CDR3 regions comprised in SEQ ID NO:319;
(e5) CDR1, CDR2, and CDR3 comprised in the antibody variable region of (1) in [1] and identical to the amino acid sequences of the CDR1, CDR2, and CDR3 regions comprised in SEQ ID NO:206; CDR1, CDR2, and CDR3 comprised in the antibody variable region of (2) in [1] and identical to the amino acid sequences of the CDR1, CDR2, and CDR3 regions comprised in SEQ ID NO:142; and CDR1, CDR2, and CDR3 comprised in the antibody variable region of the common L chain and identical to the amino acid sequences of the CDR1, CDR2, and CDR3 regions comprised in SEQ ID NO:223;
(e6) CDR1, CDR2, and CDR3 comprised in the antibody variable region of (1) in [1] and identical to the amino acid sequences of the CDR1, CDR2, and CDR3 regions comprised in SEQ ID NO:206; CDR1, CDR2, and CDR3 comprised in the antibody variable region of (2) in [1] and identical to the amino acid sequences of the CDR1, CDR2, and CDR3 regions comprised in SEQ ID NO:144; and CDR1, CDR2, and CDR3 comprised in the antibody variable region of the common L chain and identical to the amino acid sequences of the CDR1, CDR2, and CDR3 regions comprised in SEQ ID NO:223;
(e7) CDR1, CDR2, and CDR3 comprised in the antibody variable region of (1) in [1] and identical to the amino acid sequences of the CDR1, CDR2, and CDR3 regions comprised in SEQ ID NO:206; CDR1, CDR2, and CDR3 comprised in the antibody variable region of (2) in [1] and identical to the amino acid sequences of the CDR1, CDR2, and CDR3 regions comprised in SEQ ID NO:164; and CDR1, CDR2, and CDR3 comprised in the antibody variable region of the common L chain and identical to the amino acid sequences of the CDR1, CDR2, and CDR3 regions comprised in SEQ ID NO:223;

(e8) CDR1, CDR2, and CDR3 comprised in the antibody variable region of (1) in [1] and identical to the amino acid sequences of the CDR1, CDR2, and CDR3 regions comprised in SEQ ID NO:206; CDR1, CDR2, and CDR3 comprised in the antibody variable region of (2) in [1] and identical to the amino acid sequences of the CDR1, CDR2, and CDR3 regions comprised in SEQ ID NO:168; and CDR1, CDR2, and CDR3 comprised in the antibody variable region of the common L chain and identical to the amino acid sequences of the CDR1, CDR2, and CDR3 regions comprised in SEQ ID NO:223;

(e9) CDR1, CDR2, and CDR3 comprised in the antibody variable region of (1) in [1] and identical to the amino acid sequences of the CDR1, CDR2, and CDR3 regions comprised in SEQ ID NO:211; CDR1, CDR2, and CDR3 comprised in the antibody variable region of (2) in [1] and identical to the amino acid sequences of the CDR1, CDR2, and CDR3 regions comprised in SEQ ID NO:142; and CDR1, CDR2, and CDR3 comprised in the antibody variable region of the common L chain and identical to the amino acid sequences of the CDR1, CDR2, and CDR3 regions comprised in SEQ ID NO:223;

(e10) CDR1, CDR2, and CDR3 comprised in the antibody variable region of (1) in [1] and identical to the amino acid sequences of the CDR1, CDR2, and CDR3 regions comprised in SEQ ID NO:211; CDR1, CDR2, and CDR3 comprised in the antibody variable region of (2) in [1] and identical to the amino acid sequences of the CDR1, CDR2, and CDR3 regions comprised in SEQ ID NO:142; and CDR1, CDR2, and CDR3 comprised in the antibody variable region of the common L chain and identical to the amino acid sequences of the CDR1, CDR2, and CDR3 regions comprised in SEQ ID NO:299;

(e11) CDR1, CDR2, and CDR3 comprised in the antibody variable region of (1) in [1] and identical to the amino acid sequences of the CDR1, CDR2, and CDR3 regions comprised in SEQ ID NO:211; CDR1, CDR2, and CDR3 comprised in the antibody variable region of (2) in [1] and identical to the amino acid sequences of the CDR1, CDR2, and CDR3 regions comprised in SEQ ID NO:144; and CDR1, CDR2, and CDR3 comprised in the antibody variable region of the common L chain and identical to the amino acid sequences of the CDR1, CDR2, and CDR3 regions comprised in SEQ ID NO:223;

(e12) CDR1, CDR2, and CDR3 comprised in the antibody variable region of (1) in [1] and identical to the amino acid sequences of the CDR1, CDR2, and CDR3 regions comprised in SEQ ID NO:211; CDR1, CDR2, and CDR3 comprised in the antibody variable region of (2) in [1] and identical to the amino acid sequences of the CDR1, CDR2, and CDR3 regions comprised in SEQ ID NO:164; and CDR1, CDR2, and CDR3 comprised in the antibody variable region of the common L chain and identical to the amino acid sequences of the CDR1, CDR2, and CDR3 regions comprised in SEQ ID NO:223;

(e13) CDR1, CDR2, and CDR3 comprised in the antibody variable region of (1) in [1] and identical to the amino acid sequences of the CDR1, CDR2, and CDR3 regions comprised in SEQ ID NO:211; CDR1, CDR2, and CDR3 comprised in the antibody variable region of (2) in [1] and identical to the amino acid sequences of the CDR1, CDR2, and CDR3 regions comprised in SEQ ID NO:168; and CDR1, CDR2, and CDR3 comprised in the antibody variable region of the common L chain and identical to the amino acid sequences of the CDR1, CDR2, and CDR3 regions comprised in SEQ ID NO:223;

(e14) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:53;

(e15) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:299;

(e16) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:301;

(e17) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:302;

(e18) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:304;

(e19) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:306;

(e20) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:307;

(e21) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:103; and CDR1, CDR2, and CDR3 comprised in the antibody variable region of the common L chain and identical to the amino acid sequences of the CDR1, CDR2, and CDR3 regions comprised in SEQ ID NO:309;

(e22) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:122; and CDR1, CDR2, and CDR3 comprised in the antibody variable region of the common L chain and identical to the amino acid sequences of the CDR1, CDR2, and CDR3 regions comprised in SEQ ID NO:53;

(e23) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:129; and CDR1, CDR2, and CDR3 comprised in the antibody variable region of the common L chain and identical to the amino acid sequences of the CDR1, CDR2, and CDR3 regions comprised in SEQ ID NO:53;

(e24) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:132; and CDR1, CDR2, and CDR3 comprised in the antibody variable region of the common L chain and identical to the amino acid sequences of the CDR1, CDR2, and CDR3 regions comprised in SEQ ID NO:53; and (e25) CDR1, CDR2, and CDR3 comprised in the antibody variable region of (1) in [1] and identical to the amino acid sequences of the CDR1, CDR2, and CDR3 regions comprised in SEQ ID NO:215; CDR1, CDR2, and CDR3 comprised in the antibody variable region of (2) in [1] and identical to the amino acid sequences of the CDR1, CDR2, and CDR3 regions comprised in SEQ ID NO:424; and CDR1, CDR2, and CDR3 comprised in the antibody variable region of the common L chain and identical to the amino acid sequences of the CDR1, CDR2, and CDR3 regions comprised in SEQ ID NO:53.

[15] The multispecific antigen-binding molecule of any one of [1] to [4], wherein the antibody variable regions of (1) and (2) of [1] and the common L chain variable region are antibody variable regions comprising any one of the combinations of variable regions selected from (f1) to (f26) below, or antibody variable regions functionally equivalent thereto:

(f1) an H-chain variable region comprised in the antibody variable region of (1) in [1] and identical to the amino acid sequence of SEQ ID NO:197; an H-chain variable region comprised in the antibody variable region of (2) in [1] and identical to the amino acid sequence of SEQ ID NO:128; and an antibody variable region of the common L chain identical to the amino acid sequence of the variable region comprised in SEQ ID NO:53;

(f2) an H-chain variable region comprised in the antibody variable region of (1) in [1] and identical to the amino acid sequence of SEQ ID NO:197; an H-chain variable region comprised in the antibody variable region of (2) in [1] and identical to the amino acid sequence of SEQ ID NO:128; and an antibody variable region of the common L chain identical to the amino acid sequence of the variable region comprised in SEQ ID NO:299;

(f3) an H-chain variable region comprised in the antibody variable region of (1) in [1] and identical to the amino acid sequence of SEQ ID NO:197; an H-chain variable region comprised in the antibody variable region of (2) in [1] and identical to the amino acid sequence of SEQ ID NO:128; and an antibody variable region of the common L chain identical to the amino acid sequence of the variable region comprised in SEQ ID NO:310;

(f4) an H-chain variable region comprised in the antibody variable region of (1) in [1] and identical to the amino acid sequence of SEQ ID NO:197; an H-chain variable region comprised in the antibody variable region of (2) in [1] and identical to the amino acid sequence of SEQ ID NO:128; and an antibody variable region of the common L chain identical to the amino acid sequence of the variable region comprised in SEQ ID NO:319;

(f5) an H-chain variable region comprised in the antibody variable region of (1) in [1] and identical to the amino acid sequence of SEQ ID NO:206; an H-chain variable region comprised in the antibody variable region of (2) in [1] and identical to the amino acid sequence of SEQ ID NO:142; and an antibody variable region of the common L chain and identical to the amino acid sequence of the variable region comprised in SEQ ID NO:223;

(f6) an H-chain variable region comprised in the antibody variable region of (1) in [1] and identical to the amino acid sequence of SEQ ID NO:206; an H-chain variable region comprised in the antibody variable region of (2) in [1] and identical to the amino acid sequence of SEQ ID NO:144; and an antibody variable region of the common L chain identical to the amino acid sequence of the variable region comprised in SEQ ID NO:223;

(f7) an H-chain variable region comprised in the antibody variable region of (1) in [1] and identical to the amino acid sequence of SEQ ID NO:206; an H-chain variable region comprised in the antibody variable region of (2) in [1] and identical to the amino acid sequence of SEQ ID NO:164; and an antibody variable region of the common L chain and identical to the amino acid sequence of the variable region comprised in SEQ ID NO:223;

(f8) an H-chain variable region comprised in the antibody variable region of (1) in [1] and identical to the amino acid sequence of SEQ ID NO:206; an H-chain variable region comprised in the antibody variable region of (2) in [1] and identical to the amino acid sequence of SEQ ID NO:168; and an antibody variable region of the common L chain identical to the amino acid sequence of the variable region comprised in SEQ ID NO:223;

(f9) an H-chain variable region comprised in the antibody variable region of (1) in [1] and identical to the amino acid sequence of SEQ ID NO:211; an H-chain variable region comprised in the antibody variable region of (2) in [1] and identical to the amino acid sequence of SEQ ID NO:142; and an antibody variable region of the common L chain identical to the amino acid sequence of the variable region comprised in SEQ ID NO:223;

(f10) an H-chain variable region comprised in the antibody variable region of (1) in [1] and identical to the amino acid sequence of SEQ ID NO:211; an H-chain variable region comprised in the antibody variable region of (2) in [1] and identical to the amino acid sequence of SEQ ID NO:142; and an antibody variable region of the common L chain identical to the amino acid sequence of the variable region comprised in SEQ ID NO:299;

(f11) an H-chain variable region comprised in the antibody variable region of (1) in [1] and identical to the amino acid sequence of SEQ ID NO:211; an H-chain variable region comprised in the antibody variable region of (2) in [1] and identical to the amino acid sequence of SEQ ID NO:144; and an antibody variable region of the common L chain identical to the amino acid sequence of the variable region comprised in SEQ ID NO:223;

(f12) an H-chain variable region comprised in the antibody variable region of (1) in [1] and identical to the amino acid sequence of SEQ ID NO:211; an H-chain variable region comprised in the antibody variable region of (2) in [1] and identical to the amino acid sequence of SEQ ID NO:164; and an antibody variable region of the common L chain identical to the amino acid sequence of the variable region comprised in SEQ ID NO:223;

(f13) an H-chain variable region comprised in the antibody variable region of (1) in [1] and identical to the amino acid sequence of SEQ ID NO:211; an H-chain variable region comprised in the antibody variable region of (2) in [1] and identical to the amino acid sequence of SEQ ID NO:168; and an antibody variable region of the common L chain identical to the amino acid sequence of the variable region comprised in SEQ ID NO:223;

(f14) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:53;

(f15) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:299;

(f16) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:301;

(f17) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:302;

(f18) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:304;

(f19) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:306;

(f20) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:307;

(f21) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:103; and an antibody variable region of the common L chain identical to the amino acid sequence of the variable region comprised in SEQ ID NO:309;

(f22) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:122; and an antibody variable region of the common L chain identical to the amino acid sequence of the variable region comprised in SEQ ID NO:53;

(f23) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:129; and an antibody variable region of the common L chain and identical to the amino acid sequence of the variable region comprised in SEQ ID NO:53;

(f24) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:132; and an antibody variable region of the common L chain and identical to the amino acid sequence of the variable region comprised in SEQ ID NO:53;

(f25) an H-chain variable region comprised in the antibody variable region of (1) in [1] and identical to the amino acid sequence of SEQ ID NO:215; an H-chain variable region comprised in the antibody variable region of (2) in [1] and identical to the amino acid sequence of SEQ ID NO:424; and an antibody variable region of the common L chain and identical to the amino acid sequence of the variable region comprised in SEQ ID NO:53; and (f26) multispecific antigen-binding molecule that binds to an epitope overlapping with each of the epitopes on glypican 3 and T-cell receptor complex bound by the multispecific antigen-binding molecule of any one of (f1) to (f25), and which has a common L chain.

[16] The multispecific antigen-binding molecule of any one of [1] to [15], wherein the Fc region of (3) in [1] is an Fc region with an amino acid mutation at any of the Fc region-constituting amino acids of SEQ ID NOs: 23 to 26 (IgG1 to IgG4).

[17] The multispecific antigen-binding molecule of [16], wherein the Fc region of (3) in [1] is an Fc region with mutation of at least one amino acid selected from the following amino acid positions specified by EU numbering:

position 220, position 226, position 229, position 231, position 232, position 233, position 234, position 235, position 236, position 237, position 238, position 239, position 240, position 264, position 265, position 266, position 267, position 269, position 270, position 295, position 296, position 297, position 298, position 299, position 300, position 325, position 327, position 328, position 329, position 330, position 331, and position 332.

[18] The multispecific antigen-binding molecule of [16], wherein the Fc region of (3) in [1] is an Fc region comprising at least one amino acid selected from the following amino acids specified by EU numbering: Arg at amino acid position 234, Ala or Arg at amino acid position 235, Lys at amino acid position 239, and Ala at amino acid position 297.

[19] The multispecific antigen-binding molecule of any one of [16] to [18], wherein the Fc region of (3) in [1] further comprises an amino acid mutation for promoting formation of a heterodimeric Fc region.

[20] The multispecific antigen-binding molecule of [19], wherein the heterodimeric Fc region is the amino acid sequence combination of (g1) or (g2) below:

(g1) a combination of an amino acid sequence identical to the Fc region of a constant region comprising the amino acid sequence of SEQ ID NO:57, and an amino acid sequence identical to the Fc region of a constant region comprising the amino acid sequence of SEQ ID NO:58; and (g2) a combination of an amino acid sequence identical to the Fc region of a constant region comprising the amino acid sequence of SEQ ID NO:60 or 62, and an amino acid sequence identical to the Fc region of a constant region comprising the amino acid sequence of SEQ ID NO:61.

[21] The multispecific antigen-binding molecule of any one of [1] to [20], wherein the multispecific antigen-binding molecule is a bispecific antibody.

[22] A bispecific antibody of any one of (h1) to (h25) below:

(h1) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:424 and a constant region having the amino acid sequence of SEQ ID NO:60 or 62; and a common antibody L chain having the amino acid sequence of SEQ ID NO:53;

(h2) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:53;

(h3) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:299;

(h4) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:301;

(h5) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:302;

(h6) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:304;

(h7) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:306;

(h8) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:307;

(h9) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:103 and a constant region having the amino acid sequence of SEQ ID NO:60 or 62; and a common antibody L chain having the amino acid sequence of SEQ ID NO:309;

(h10) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:122 and a constant region having the amino acid sequence of SEQ ID NO:60 or 62; and a common antibody L chain having the amino acid sequence of SEQ ID NO:53;

(h11) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:129 and a constant region having the amino acid sequence of SEQ ID NO:60 or 62; and a common antibody L chain having the amino acid sequence of SEQ ID NO:53;

(h12) a bispecific antibody having an antibody H chain having glypican 3-binding activity that comprises an antibody H-chain variable region having the amino acid sequence of SEQ ID NO:215 and a constant region having the amino acid sequence of SEQ ID NO:61; an antibody H chain having T-cell receptor complex-binding activity that comprises an antibody H-chain variable region having the amino acid sequence of SEQ ID NO:132 and a constant region having the amino acid sequence of SEQ ID NO:60 or 62; and a common antibody L chain having the amino acid sequence of SEQ ID NO:53;

(h13) a bispecific antibody having an antibody H chain having glypican 3-binding activity that comprises an antibody H-chain variable region having the amino acid sequence of SEQ ID NO:197 and a constant region having the amino acid sequence of SEQ ID NO:61; an antibody H chain having T-cell receptor complex-binding activity that comprises an antibody H-chain variable region having the amino acid sequence of SEQ ID NO:128 and a constant region having the amino acid sequence of SEQ ID NO:60 or 62; and a common antibody L chain having the amino acid sequence of SEQ ID NO:299;

(h14) a bispecific antibody having an antibody H chain having glypican 3-binding activity that comprises an antibody H-chain variable region having the amino acid sequence of SEQ ID NO:197 and a constant region having the amino acid sequence of SEQ ID NO:61; an antibody H chain having T-cell receptor complex-binding activity that comprises an antibody H-chain variable region having the amino acid sequence of SEQ ID NO:128 and a constant region having the amino acid sequence of SEQ ID NO:60 or 62; and a common antibody L chain having the amino acid sequence of SEQ ID NO:310;
(h15) a bispecific antibody having an antibody H chain having glypican 3-binding activity that comprises an antibody H-chain variable region having the amino acid sequence of SEQ ID NO:197 and a constant region having the amino acid sequence of SEQ ID NO:61; an antibody H chain having T-cell receptor complex-binding activity that comprises an antibody H-chain variable region having the amino acid sequence of SEQ ID NO:128 and a constant region having the amino acid sequence of SEQ ID NO:60 or 62; and a common antibody L chain having the amino acid sequence of SEQ ID NO:319;
(h16) a bispecific antibody having an antibody H chain having glypican 3-binding activity that comprises an antibody H-chain variable region having the amino acid sequence of SEQ ID NO:197 and a constant region having the amino acid sequence of SEQ ID NO:61; an antibody H chain having T-cell receptor complex-binding activity that comprises an antibody H-chain variable region having the amino acid sequence of SEQ ID NO:128 and a constant region having the amino acid sequence of SEQ ID NO:60 or 62; and a common antibody L chain having the amino acid sequence of SEQ ID NO:53;
(h17) a bispecific antibody having an antibody H chain having glypican 3-binding activity that comprises an antibody H-chain variable region having the amino acid sequence of SEQ ID NO:211 and a constant region having the amino acid sequence of SEQ ID NO:61; an antibody H chain having T-cell receptor complex-binding activity that comprises an antibody H-chain variable region having the amino acid sequence of SEQ ID NO:142 and a constant region having the amino acid sequence of SEQ ID NO:60 or 62; and a common antibody L chain having the amino acid sequence of SEQ ID NO:299;
(h18) a bispecific antibody having an antibody H chain having glypican 3-binding activity that comprises an antibody H-chain variable region having the amino acid sequence of SEQ ID NO:211 and a constant region having the amino acid sequence of SEQ ID NO:61; an antibody H chain having T-cell receptor complex-binding activity that comprises an antibody H-chain variable region having the amino acid sequence of SEQ ID NO:142 and a constant region having the amino acid sequence of SEQ ID NO:60 or 62; and a common antibody L chain having the amino acid sequence of SEQ ID NO:223;
(h19) a bispecific antibody having an antibody H chain having glypican 3-binding activity that comprises an antibody H-chain variable region having the amino acid sequence of SEQ ID NO:211 and a constant region having the amino acid sequence of SEQ ID NO:61; an antibody H chain having T-cell receptor complex-binding activity that comprises an antibody H-chain variable region having the amino acid sequence of SEQ ID NO:144 and a constant region having the amino acid sequence of SEQ ID NO:60 or 62; and a common antibody L chain having the amino acid sequence of SEQ ID NO:223;
(h20) a bispecific antibody having an antibody H chain having glypican 3-binding activity that comprises an antibody H-chain variable region having the amino acid sequence of SEQ ID NO:206 and a constant region having the amino acid sequence of SEQ ID NO:61; an antibody H chain having T-cell receptor complex-binding activity that comprises an antibody H-chain variable region having the amino acid sequence of SEQ ID NO:144 and a constant region having the amino acid sequence of SEQ ID NO:60 or 62; and a common antibody L chain having the amino acid sequence of SEQ ID NO:223;
(h21) a bispecific antibody having an antibody H chain having glypican 3-binding activity that comprises an antibody H-chain variable region having the amino acid sequence of SEQ ID NO:206 and a constant region having the amino acid sequence of SEQ ID NO:61; an antibody H chain having T-cell receptor complex-binding activity that comprises an antibody H-chain variable region having the amino acid sequence of SEQ ID NO:142 and a constant region having the amino acid sequence of SEQ ID NO:60 or 62; and a common antibody L chain having the amino acid sequence of SEQ ID NO:223;
(h22) a bispecific antibody having an antibody H chain having glypican 3-binding activity that comprises an antibody H-chain variable region having the amino acid sequence of SEQ ID NO:206 and a constant region having the amino acid sequence of SEQ ID NO:61; an antibody H chain having T-cell receptor complex-binding activity that comprises an antibody H-chain variable region having the amino acid sequence of SEQ ID NO:164 and a constant region having the amino acid sequence of SEQ ID NO:60 or 62; and a common antibody L chain having the amino acid sequence of SEQ ID NO:223;
(h23) a bispecific antibody having an antibody H chain having glypican 3-binding activity that comprises an antibody H-chain variable region having the amino acid sequence of SEQ ID NO:206 and a constant region having the amino acid sequence of SEQ ID NO:61; an antibody H chain having T-cell receptor complex-binding activity that comprises an antibody H-chain variable region having the amino acid sequence of SEQ ID NO:168 and a constant region having the amino acid sequence of SEQ ID NO:60 or 62; and a common antibody L chain having the amino acid sequence of SEQ ID NO:223;
(h24) a bispecific antibody having an antibody H chain having glypican 3-binding activity that comprises an antibody H-chain variable region having the amino acid sequence of SEQ ID NO:211 and a constant region having the amino acid sequence of SEQ ID NO:61; an antibody H chain having T-cell receptor complex-binding activity that comprises an antibody H-chain variable region having the amino acid sequence of SEQ ID NO:164 and a constant region having the amino acid sequence of SEQ ID NO:60 or 62; and a common antibody L chain having the amino acid sequence of SEQ ID NO:223; and
(h25) a bispecific antibody having an antibody H chain having glypican 3-binding activity that comprises an antibody H-chain variable region having the amino acid sequence of SEQ ID NO:211 and a constant region having the amino acid sequence of SEQ ID NO:61; an antibody H chain having T-cell receptor complex-binding activity that comprises an antibody H-chain variable region having the amino acid sequence of SEQ ID NO:168 and a constant region having the amino acid sequence of SEQ ID NO:60 or 62; and a common antibody L chain having the amino acid sequence of SEQ ID NO:223.

[23] A nucleic acid that encodes the multispecific antigen-binding molecule of any one of [1] to [20] or the bispecific antibody of [21] or [22].

[24] A vector into which the nucleic acid of [23] is introduced.

[25] A cell comprising the nucleic acid of [23] or the vector of [24].

[26] A method for producing the multispecific antigen-binding molecule of any one of [1] to [20] or the bispecific antibody of [21] or [22] by culturing the cell of [25].

[27] A multispecific antigen-binding molecule or a bispecific antibody produced by the method of [26].

[28] A pharmaceutical composition comprising the multispecific antigen-binding molecule of any one of [1] to [20] or the bispecific antibody of [21] or [22], and a pharmaceutically acceptable carrier.

[29] The pharmaceutical composition of [28], which induces cytotoxicity.

[30] The pharmaceutical composition of [29], wherein the cytotoxicity is T-cell-dependent cytotoxicity.

[31] The pharmaceutical composition of [28], which is for administration to a patient in need of the multispecific antigen-binding molecule of any one of [1] to [20] or the bispecific antibody of [21] or [22].

Furthermore, the present invention relates to a kit to be used in a method of the present invention, wherein the kit comprises a multispecific antigen-binding molecule of the present invention, or a multispecific antigen-binding molecule produced by the production method of the present invention. The present invention also relates to use of a multispecific antigen-binding molecule of the present invention, or use of a multispecific antigen-binding molecule produced by the production method of the present invention in the manufacture of a pharmaceutical composition for activating cytotoxic activity. The present invention additionally relates to a multispecific antigen-binding molecule of the present invention, or a multispecific antigen-binding molecule produced by the production method of the present invention to be used in a method of the present invention. Herein, multispecific antigen-binding molecules include bispecific antibodies of the present invention.

Furthermore, the present invention relates to a multispecific antigen-binding molecule comprising the following domains:
(1) a domain comprising an antibody variable region having glypican 3-binding activity;
(2) a domain comprising an antibody variable region having T-cell receptor complex-binding activity;
wherein the L-chain variable regions contained in the variable regions of (1) and (2) have a commonly shared amino acid sequence. The present invention also relates to the domain of (1), which is more specifically a domain that comprises antibody heavy-chain and/or light-chain variable regions having glypican 3-binding activity, and which is comprised in the multispecific antigen-binding molecule. The present invention additionally relates to the domain of (2), which is more specifically a domain that comprises an antibody variable region having T-cell receptor complex-binding activity, and which is comprised in the multispecific antigen-binding molecule. Details of the domains of (1) and (2) may include those described in [1] to [22] mentioned above. The multispecific antigen-binding molecule may be a bispecific antibody. Furthermore, the multispecific antigen-binding molecule may further comprise a domain comprising an Fc region, and the Fc region may have a reduced Fcγ receptor-binding activity. Details of the domain comprising an Fc region may include those described in [1] to [22] mentioned above. The present invention relates to a nucleic acid encoding the multispecific antigen-binding molecule or the domains, a vector introduced with the nucleic acid, a cell comprising the nucleic acid or the vector, a method for producing the multispecific antigen-binding molecule by culturing the cells, and a multispecific antigen-binding molecule or domains comprising an antibody variable region having glypican 3-binding activity or T-cell receptor complex-binding activity produced by the method. Furthermore, the present invention relates to a pharmaceutical composition comprising the multispecific antigen-binding molecule and a pharmaceutically acceptable carrier. The pharmaceutical composition may induce cell injury, the cell injury may be T-cell-dependent cellular cytotoxicity, and the composition may be for administration to a patient in need of the multispecific antigen-binding molecule.

The present invention also provides a multispecific antigen-binding molecule that binds to epitopes overlapping and/or competing with epitopes on each of glypican 3 and T-cell receptor complex bound by the multispecific antigen-binding molecule of any one of (e1) to (e25) of [14] mentioned above, and a multispecific antigen-binding molecule that binds to epitopes overlapping and/or competing with epitopes on each of glypican 3 and T-cell receptor complex bound by the multispecific antigen-binding molecule of any one of (f1) to (f25) of [15].

Regarding (g1) and (g2) of [20] mentioned above, of the two Fc regions, the former Fc region may be included in the antibody H chain having glypican 3-binding activity and the latter Fc region may be included in the antibody H chain having T-cell receptor complex-binding activity; or the former Fc region may be included in the antibody H chain having T-cell receptor complex-binding activity and the latter Fc region may be included in the antibody H chain having glypican 3-binding activity.

Effects of the Invention

The present invention provides novel multispecific antigen-binding molecules with molecular forms that can be produced with high efficiency, which maintain the strong antitumor activity possessed by BiTE and the excellent safety property of not causing cancer antigen-independent induction of a cytokine storm and such, and have long half-lives in blood. Pharmaceutical compositions that activate cytotoxic activity, which comprise a multispecific antigen-binding molecule of the present invention as active ingredient, target cancer tissues containing glypican 3-expressing cancer cells to cause cell injury, and can treat or prevent various cancers. The invention enables desirable treatment which has not only a high level of safety but also reduced physical burden, and is highly convenient for patients.

and the filled triangle (▲) indicate the cytotoxic activity of GPC3_ERY22_rCE115 and GPC3_ERY27_hCE115, respectively.

Figure 3:
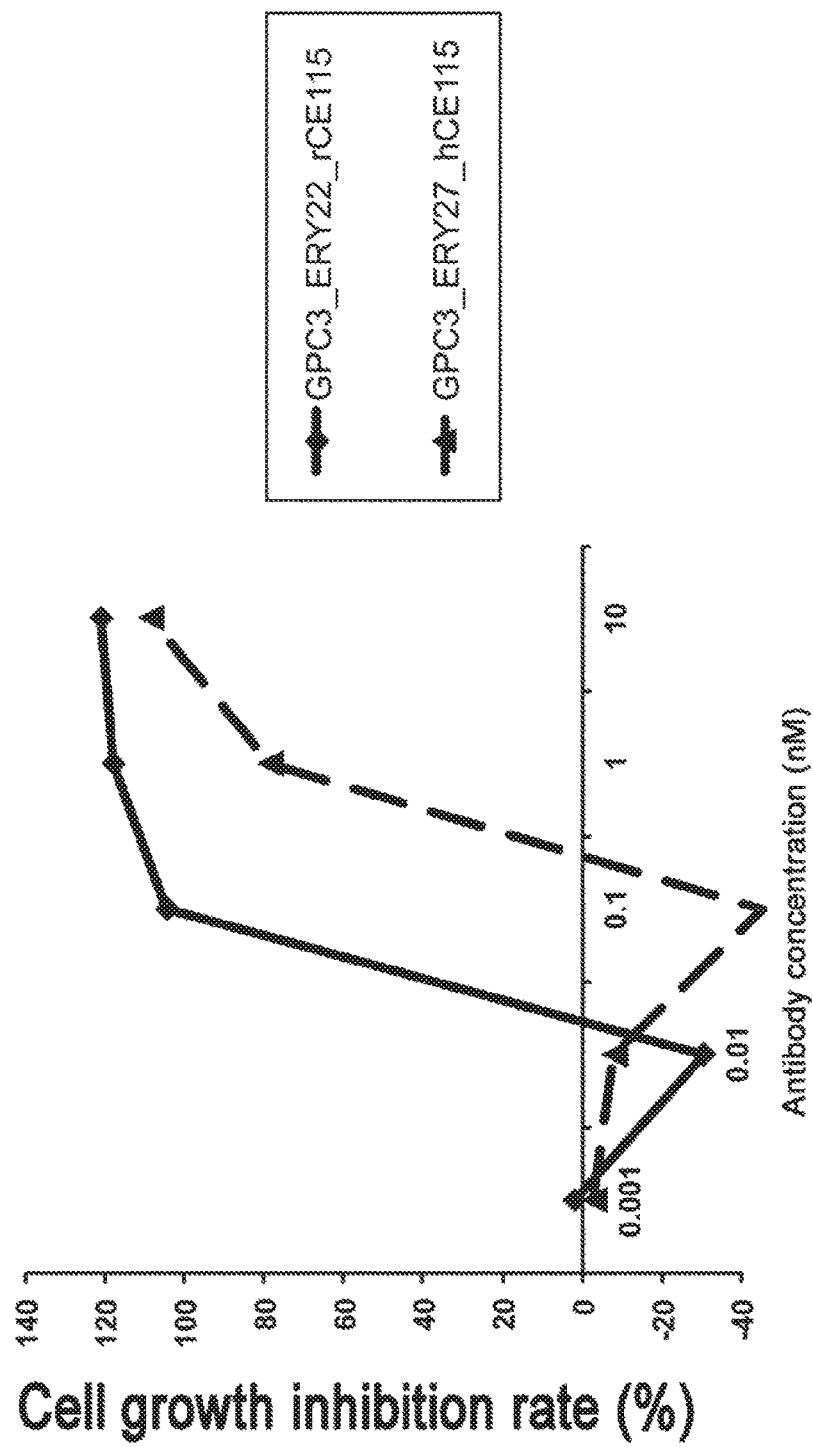

FIG. 3 is a graph showing the cytotoxic activities of GPC3_ERY22_rCE115 and GPC3_ERY27_hCE115 when PC-10 is used as the target cell. The filled diamond (♦) and the filled triangle (▲) indicate the cytotoxic activity of GPC3_ERY22_rCE115 and GPC3_ERY27_hCE115, respectively.

Figure 4A:
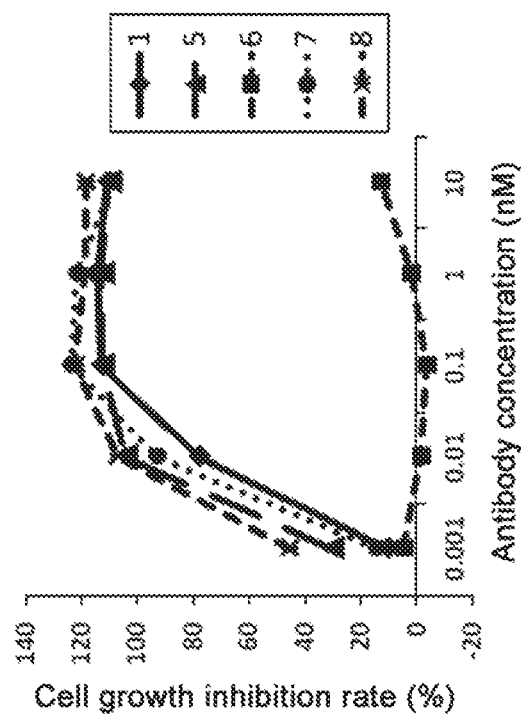
Figure 4B:
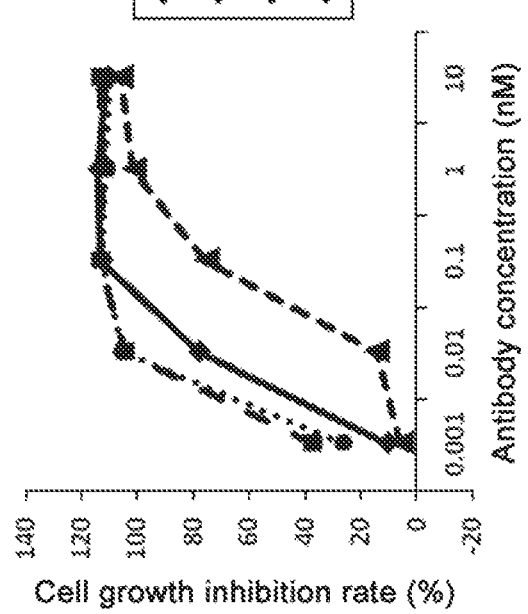

FIG. 4A and 4B is a graph showing the cytotoxic activities of the optimized antibodies when NCI-H446 is used as the target cell.

Figures 5A, 5B:
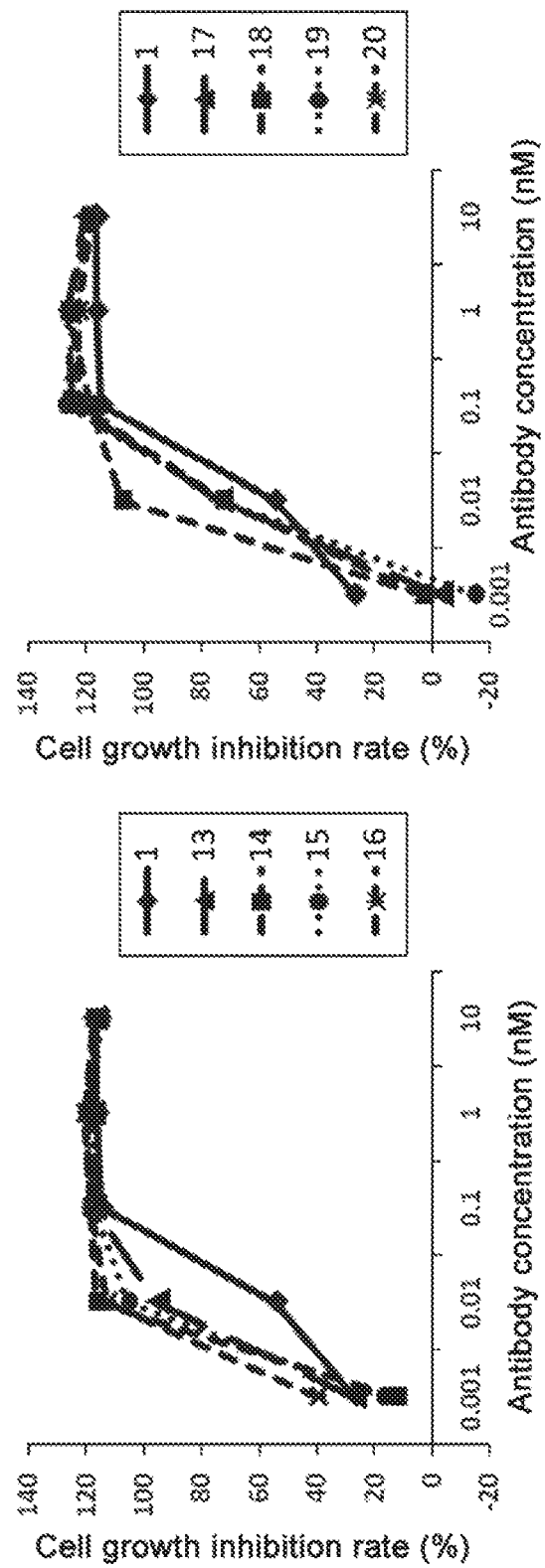

FIG. 5A and 5B is a graph showing the cytotoxic activities of the optimized antibodies when NCI-H446 is used as the target cell.

Figure 6A:
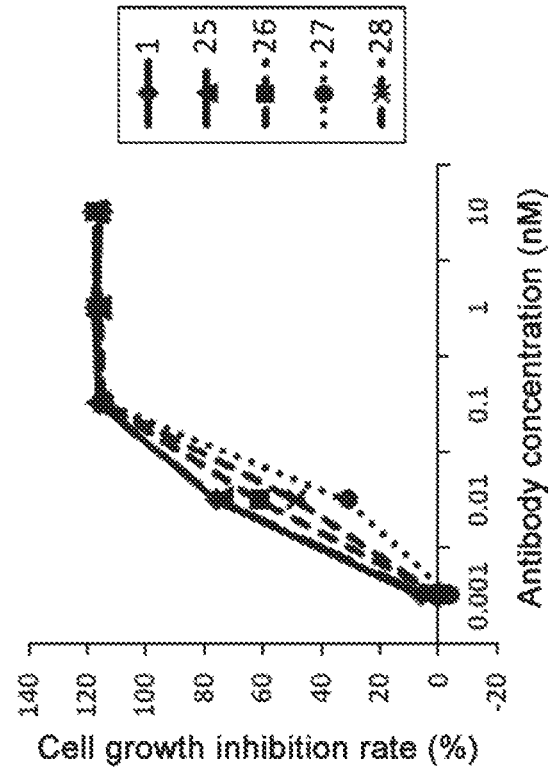
Figure 6B:
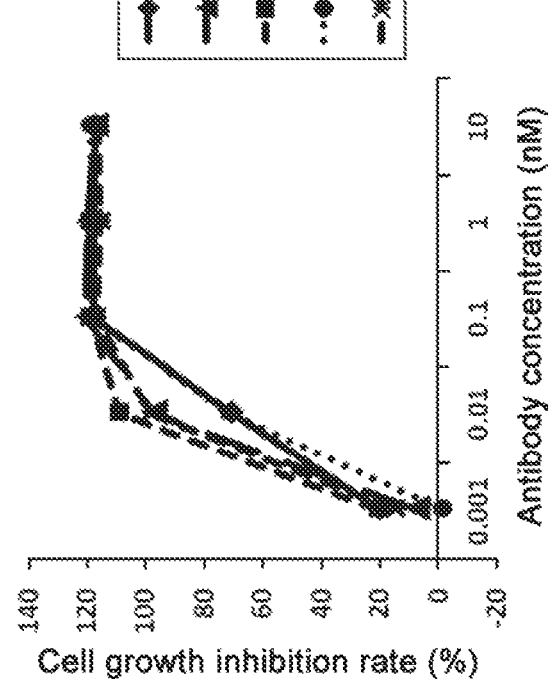

FIG. 6A and 6B is a graph showing the cytotoxic activities of the optimized antibodies when NCI-H446 is used as the target cell.

Figures 7A, 7B:
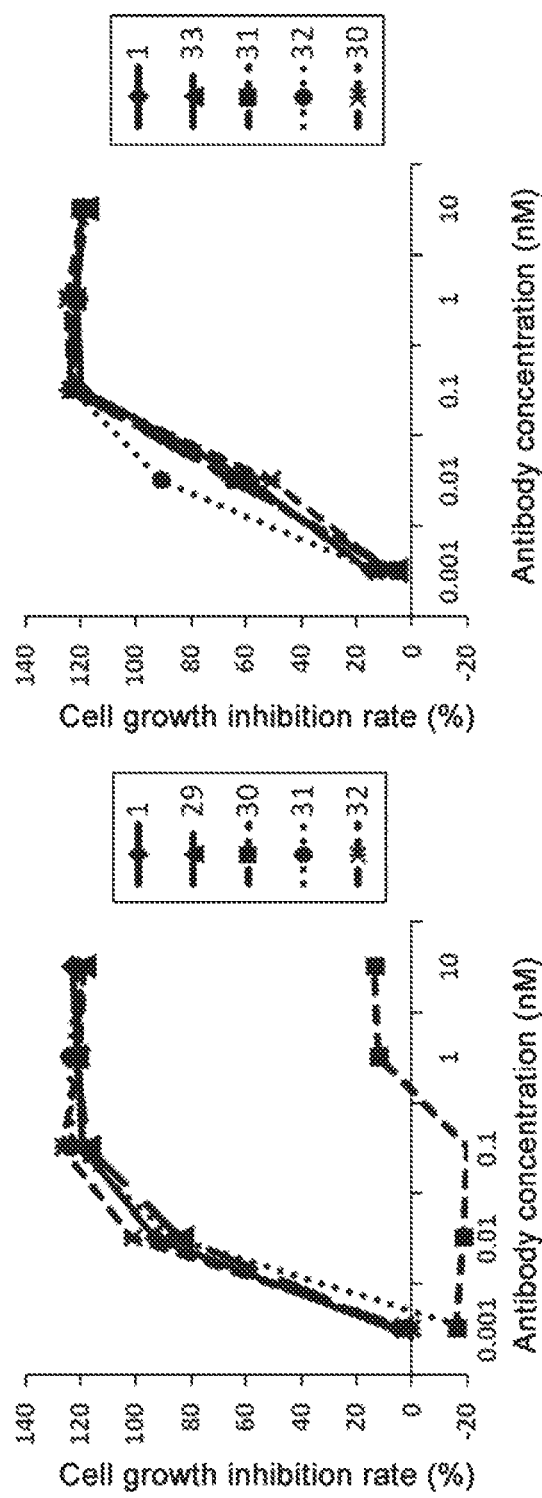

FIG. 7A and 7B is a graph showing the cytotoxic activities of the optimized antibodies when NCI-H446 is used as the target cell.

Figure 8A:
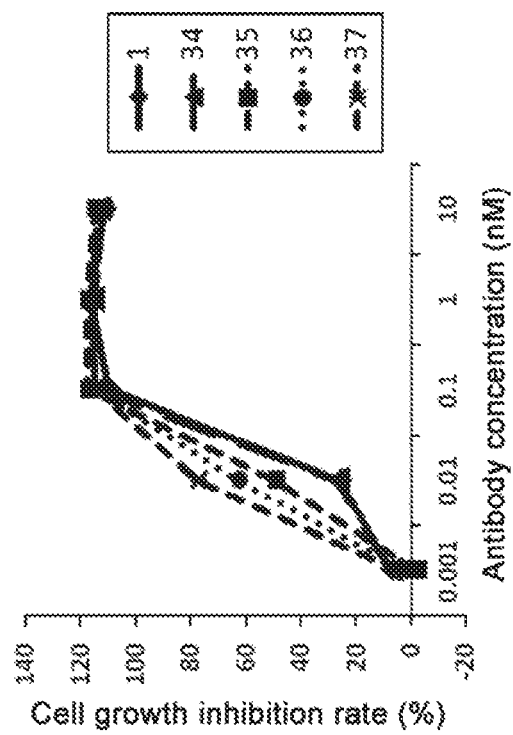
Figure 8B:
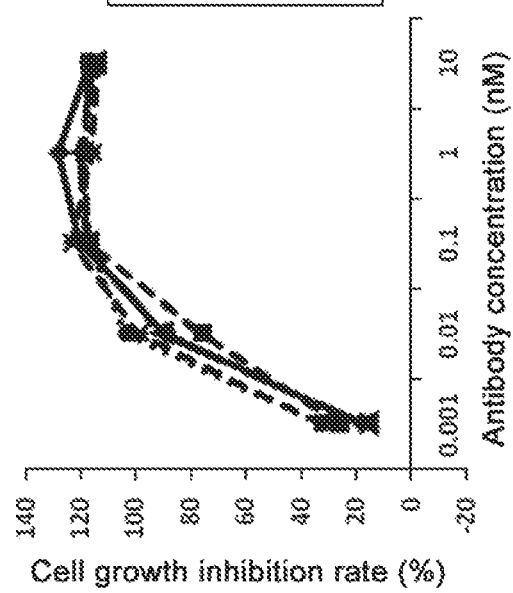

FIG. 8A and 8B is a graph showing the cytotoxic activities of the optimized antibodies when NCI-H446 is used as the target cell.

Figure 9A:
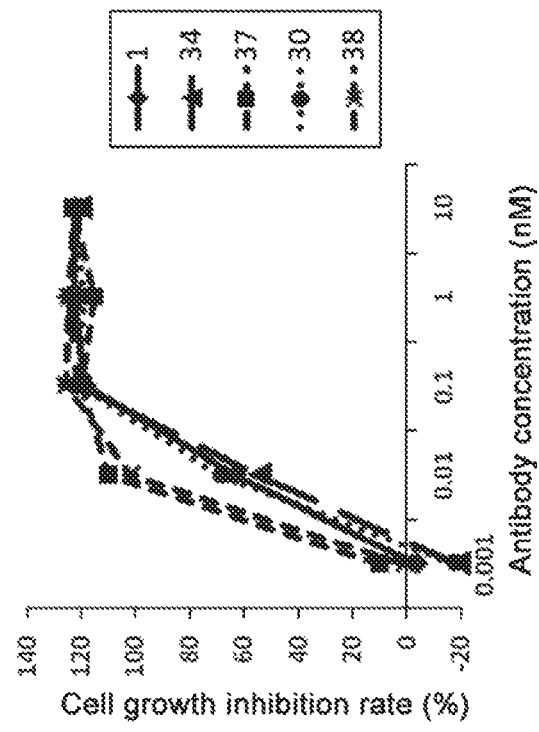
Figure 9B:
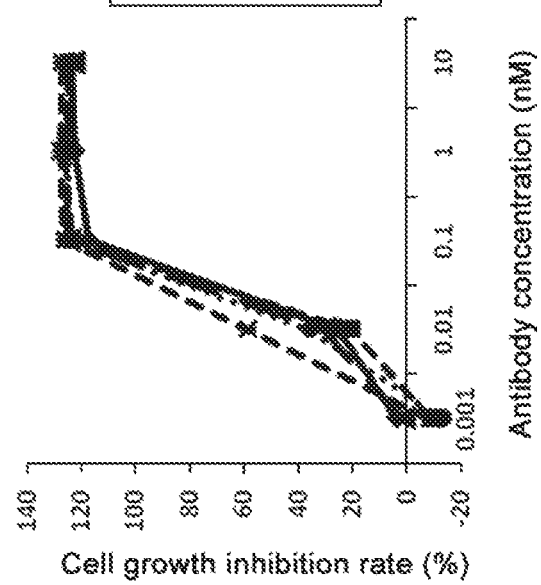

FIG. 9A and 9B is a graph showing the cytotoxic activities of the optimized antibodies when NCI-H446 is used as the target cell.

Figure 10A:
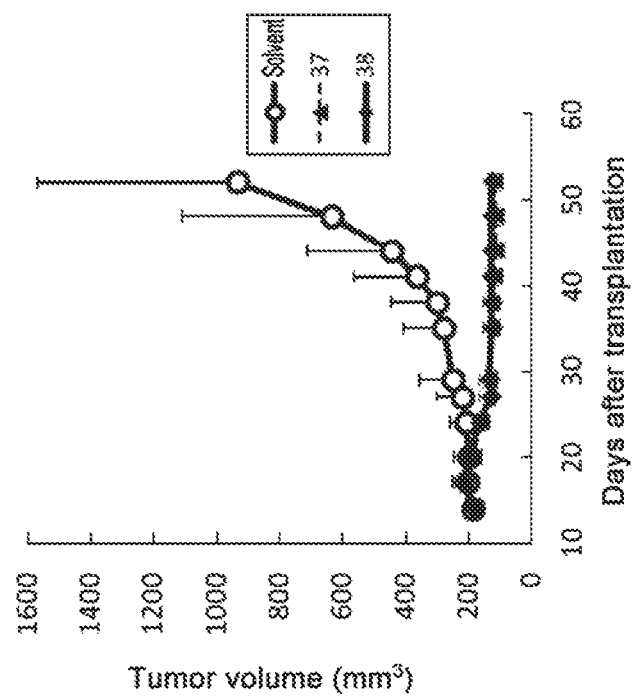
Figure 10B:
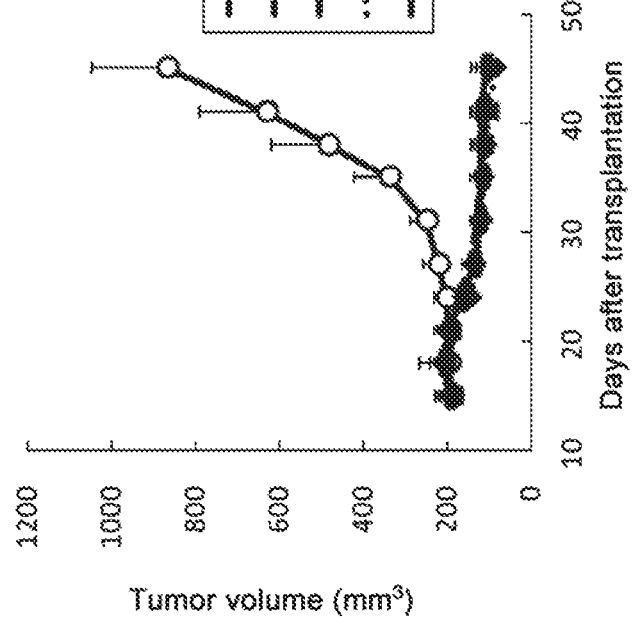

FIG. 10A and 10B show the in vivo antitumor effects of the optimized antibodies when PC-10 is used as the target cell.

Figures 11A, 11B:
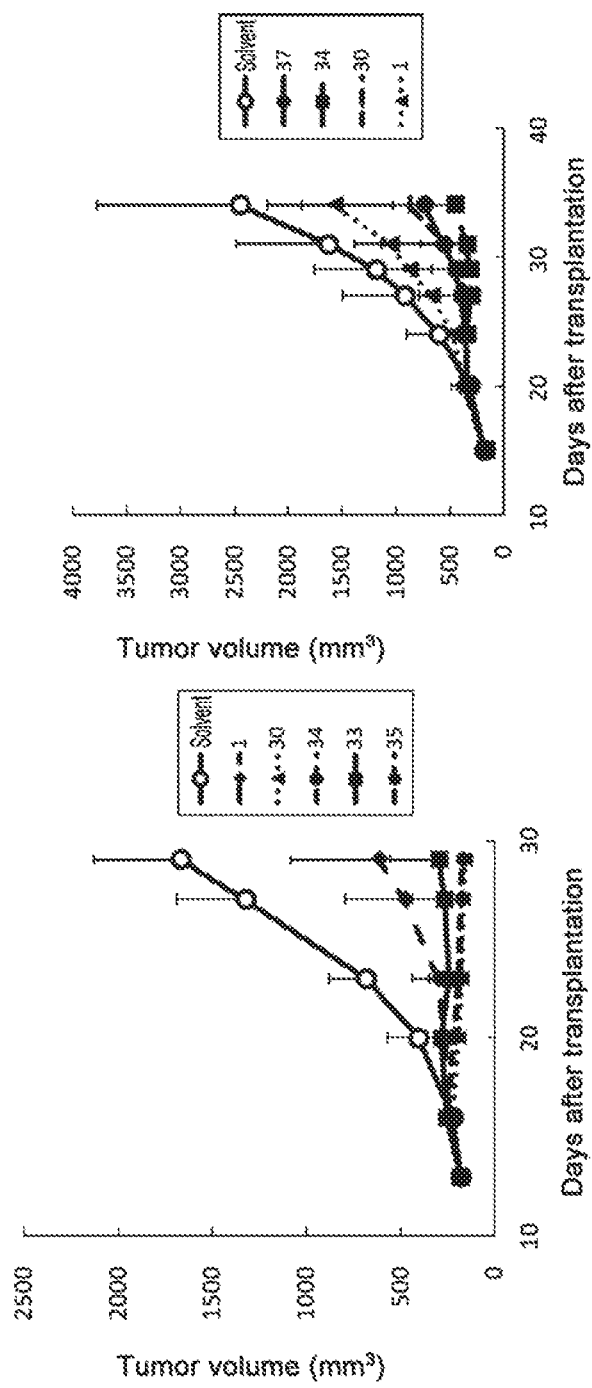

FIG. 11A and 11B show the in vivo antitumor effects of the optimized antibodies when NCI-H446 is used as the target cell.

Figure 12:
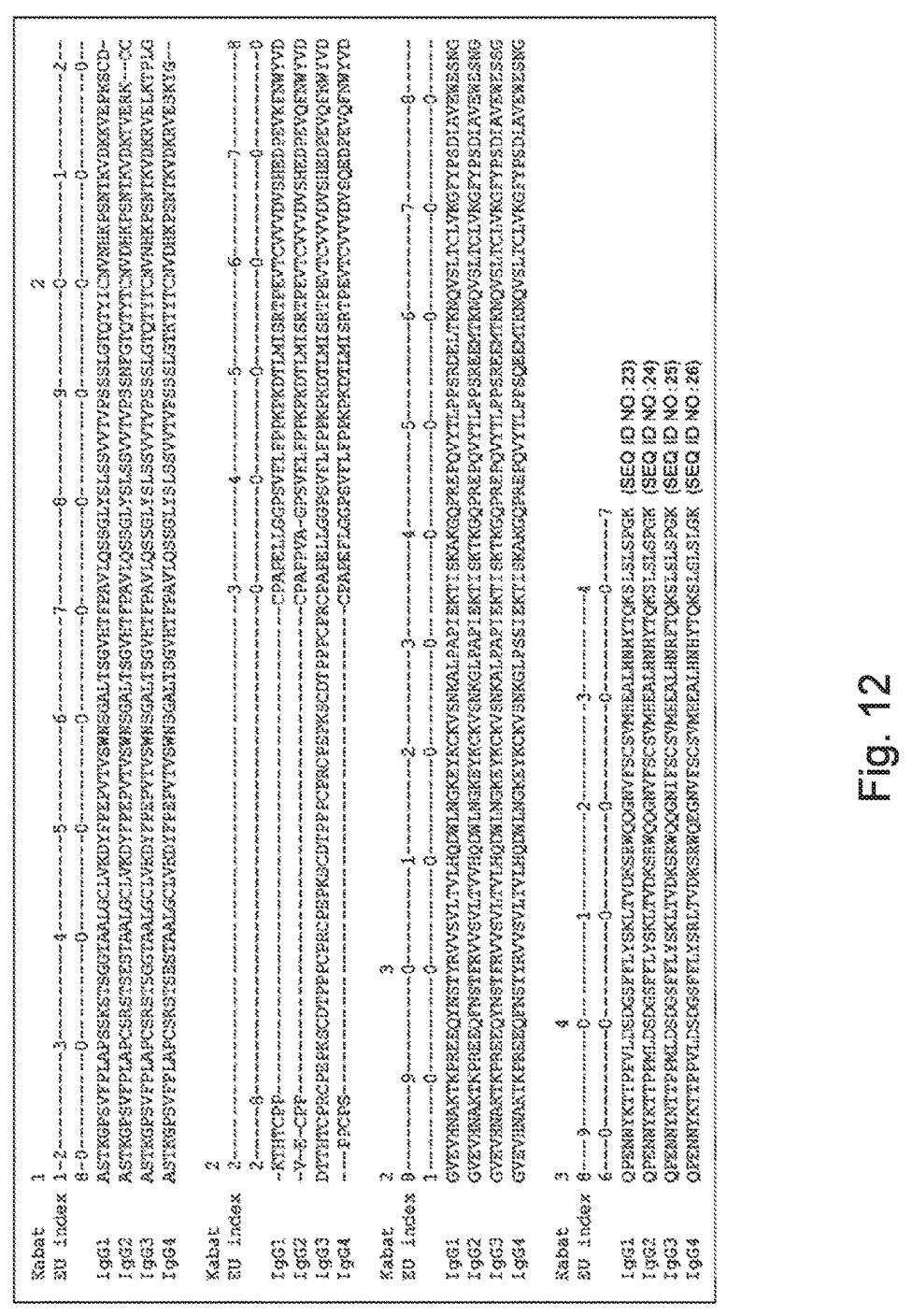

FIG. 12 shows the relationship between the amino acid residues constituting the Fc regions of IgG1, IgG2, IgG3, and IgG4, and the Kabat EU numbering system (herein, also referred to as EU INDEX).

Figures 1, 13:
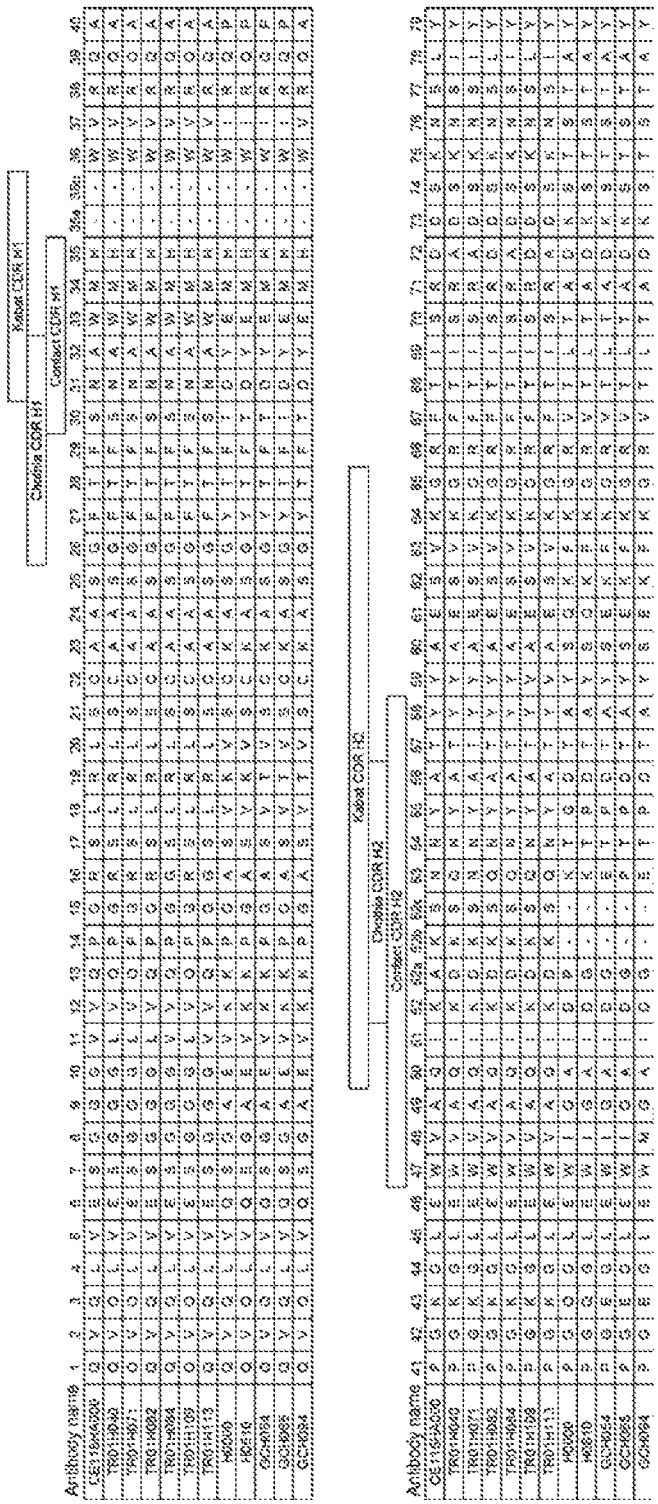
FIGs. 1A and 1B show schematic diagrams of ERY22 (FIG. 1A) and ERY27 (FIG. 1B).

FIG. 13-1 shows the heavy-chain variable region sequences of amino acid residues 1-79 of CE115HA000 (SEQ ID NO:52), TR01H040 (SEQ ID NO:103), TR01H071 (SEQ ID NO:132), TR01H082 (SEQ ID NO:142), TR01H084 (SEQ ID NO:144), TR01H109 (SEQ ID NO:164), TR01H113 (SEQ ID NO:168), H0000 (SEQ ID NO:40), H0610 (SEQ ID NO:215), GCH054 (SEQ ID NO:197), GCH065 (SEQ ID NO:206), and GCH094 (SEQ ID NO:211) according to Kabat et al.

Figure 2:
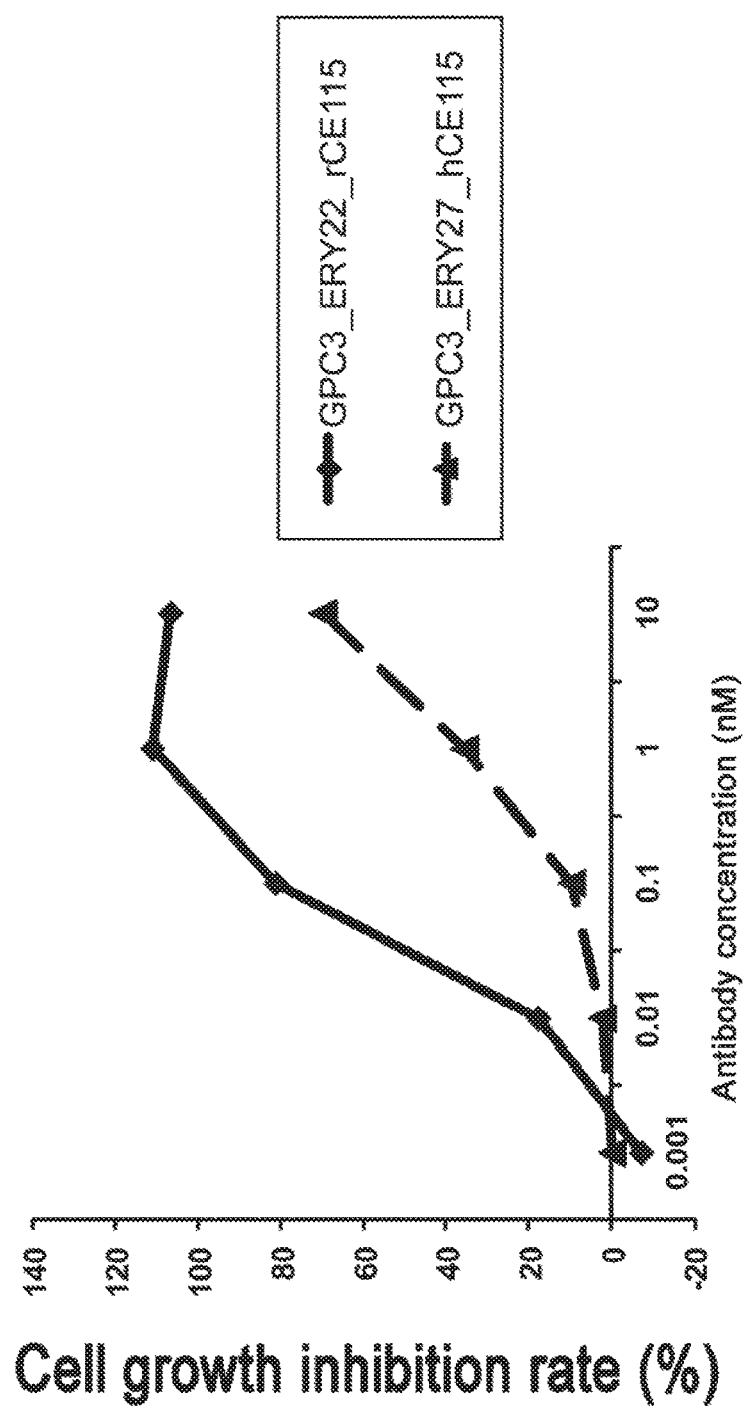
FIG. 2 is a graph showing the cytotoxic activities of GPC3_ERY22_rCE115 and GPC3_ERY27_hCE115 when NCI-H446 is used as the target cell. The filled diamond (◆)

FIG. 13-2 shows the heavy-chain variable region sequences of amino acid residues 80-113 of CE115HA000 (SEQ ID NO:52), TR01H040 (SEQ ID NO:103), TR01H071 (SEQ ID NO:132), TR01H082 (SEQ ID NO:142), TR01H084 (SEQ ID NO:144), TR01H109(SEQ ID NO:164), TR01H113 (SEQ ID NO:168), H0000 (SEQ ID NO:40), H0610 (SEQ ID NO:215), GCH054 (SEQ ID NO:197), GCH065 (SEQ ID NO:206), and GCH094 (SEQ ID NO:211) according to Kabat et al.

Figure 14:
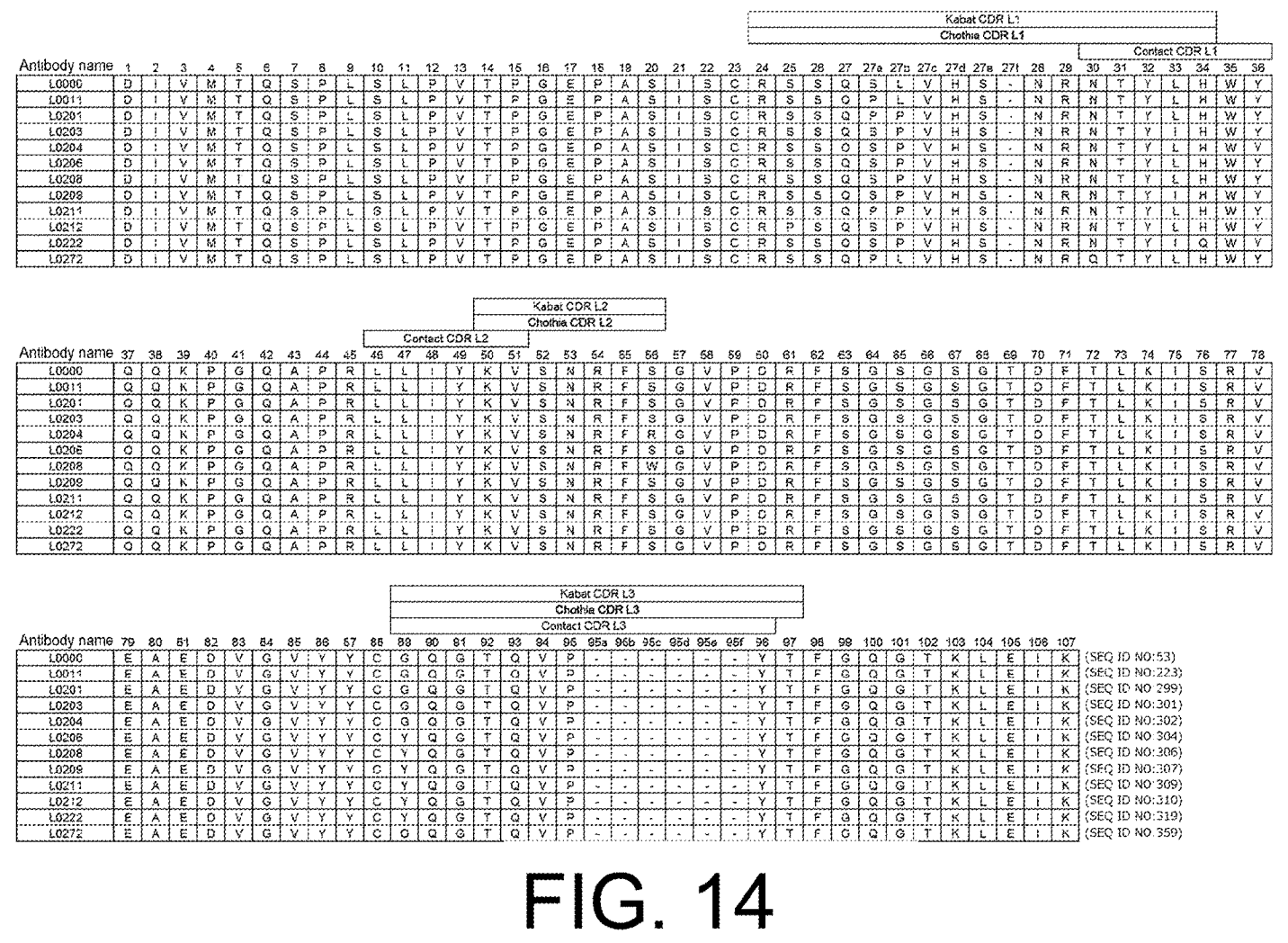

FIG. 14 shows the light-chain variable region sequences of L0000 (SEQ ID NO:53), L0011 (SEQ ID NO:223), L0201 (SEQ ID NO:299), L0203 (SEQ ID NO:301), L0204 (SEQ ID NO:302), L0206 (SEQ ID NO:304), L0208 (SEQ ID NO:306), L0209 (SEQ ID NO:307), L0211 (SEQ ID NO:309), L0212 (SEQ ID NO:310), L0222 (SEQ ID NO:319), and L0272(SEQ ID NO:359), and their numbering according to Kabat et al.

MODE FOR CARRYING OUT THE INVENTION

The definitions below are provided to help understanding of the present invention illustrated herein.

Antibody

Herein, "antibody" refers to a natural immunoglobulin or an immunoglobulin produced by partial or complete synthesis. Antibodies can be isolated from natural sources such as naturally-occurring plasma and serum, or culture supernatants of antibody-producing hybridomas. Alternatively, antibodies can be partially or completely synthesized using techniques such as genetic recombination. Preferred antibodies include, for example, antibodies of an immunoglobulin isotype or subclass belonging thereto. Known human immunoglobulins include antibodies of the following nine classes (isotypes): IgG1, IgG2, IgG3, IgG4, IgA1, IgA2, IgD, IgE, and IgM. Of these isotypes, antibodies of the present invention include IgG1, IgG2, IgG3, and IgG4.

Methods for producing an antibody with desired binding activity are known to those skilled in the art. Below is an example that describes a method for producing an antibody (anti-GPC3 antibody) that binds to Glypican-3 (hereinafter, also referred to as GPC3), which belongs to the GPI-anchored receptor family (Int J Cancer. (2003) 103(4), 455-65). Antibodies that bind to a T-cell receptor complex can also be produced according to the example described below.

Anti-GPC3 antibodies can be obtained as polyclonal or monoclonal antibodies using known methods. The anti-GPC3 antibodies preferably produced are monoclonal antibodies derived from mammals. Such mammal-derived monoclonal antibodies include antibodies produced by hybridomas or host cells transformed with an expression vector carrying an antibody gene by genetic engineering techniques.

Monoclonal antibody-producing hybridomas can be produced using known techniques, for example, as described below. Specifically, mammals are immunized by conventional immunization methods using a GPC3 protein as a sensitizing antigen. Resulting immune cells are fused with known parental cells by conventional cell fusion methods. Then, hybridomas producing an anti-GPC3 antibody can be selected by screening for monoclonal antibody-producing cells using conventional screening methods.

Specifically, monoclonal antibodies are prepared as mentioned below. First, the GPC3 gene whose nucleotide sequence is disclosed in RefSeq accession number NM_001164617.1 (SEQ ID NO:1) can be expressed to produce a GPC3 protein shown in RefSeq accession number NP_001158089.1 (SEQ ID NO:2), which will be used as a sensitizing antigen for antibody preparation. That is, a gene sequence encoding GPC3 is inserted into a known expression vector, and appropriate host cells are transformed with this vector. The desired human GPC3 protein is purified from the host cells or their culture supernatants by known methods. For example, to prepare soluble GPC3 from culture supernatants, amino acids at positions 564 to 580 that form the hydrophobic region corresponding to the GPI-anchor sequence used to anchor GPC3 on the cell membrane are deleted from the GPC3 polypeptide sequence of SEQ ID NO:2, and then the resulting protein is expressed instead of the GPC3 protein of SEQ ID NO:2. Alternatively, it is possible to use a purified natural GPC3 protein as a sensitizing antigen.

The purified GPC3 protein can be used as a sensitizing antigen for use in immunization of mammals. Partial peptides of GPC3 can also be used as sensitizing antigens. In this case, the partial peptides may also be obtained by chemical synthesis from the human GPC3 amino acid sequence. Furthermore, they may also be obtained by incorporating a portion of the GPC3 gene into an expression vector and expressing it. Moreover, they may also be obtained by degrading the GPC3 protein using proteases, but the region and size of the GPC3 peptide used as the partial peptide are not particularly limited to a special embodiment. As the preferred region, any sequence from the amino acid sequence corresponding to the amino acids at positions 524 to 563, or more preferably any sequence from the amino acid sequence corresponding to the amino acids at positions 537 to 563 in the amino acid sequence of SEQ ID NO:2 may be selected. Preferably, any sequence may be selected from the amino acid sequence of the region not containing the amino acid sequence corresponding to amino acids at positions 550 to 663 in the amino acid sequence of SEQ ID NO:2. Preferably, any sequence may be selected from the amino acid sequence corresponding to positions 544 to 553, and more preferably, any sequence may be selected from the amino acid sequence corresponding to positions 546 to 551 in the amino acid sequence of SEQ ID NO:2. The number of amino acids constituting a peptide to be used as the sensitizing antigen is at least five or more, or preferably for example, six or more, or seven or more. More specifically, peptides consisting of 8 to 50 residues or preferably 10 to 30 residues may be used as the sensitizing antigen.

For sensitizing antigen, alternatively it is possible to use a fusion protein prepared by fusing a desired partial polypeptide or peptide of the GPC3 protein with a different polypeptide. For example, antibody Fc fragments and peptide tags are preferably used to produce fusion proteins to be used as sensitizing antigens. Vectors for expression of such fusion proteins can be constructed by fusing in frame genes encoding two or more desired polypeptide fragments and inserting the fusion gene into an expression vector as described above. Methods for producing fusion proteins are described in Molecular Cloning 2nd ed. (Sambrook, J et al., Molecular Cloning 2nd ed., 9.47-9.58 (1989) Cold Spring Harbor Lab. Press). Methods for preparing GPC3 to be used as a sensitizing antigen, and immunization methods using GPC3 are specifically described in WO 2003/000883, WO 2004/022754, and WO 2006/006693.

There is no particular limitation on the mammals to be immunized with the sensitizing antigen. However, it is preferable to select the mammals by considering their compatibility with the parent cells to be used for cell fusion. In general, rodents such as mice, rats, and hamsters, rabbits, and monkeys are preferably used.

The above animals are immunized with a sensitizing antigen by known methods. Generally performed immunization methods include, for example, intraperitoneal or subcutaneous injection of a sensitizing antigen into mammals. Specifically, a sensitizing antigen is appropriately diluted with PBS (Phosphate-Buffered Saline), physiological saline, or the like. If desired, a conventional adjuvant such as Freund's complete adjuvant is mixed with the antigen, and the mixture is emulsified. Then, the sensitizing antigen is administered to a mammal several times at 4- to 21-day intervals. Appropriate carriers may be used in immunization with the sensitizing antigen. In particular, when a low-molecular-weight partial peptide is used as the sensitizing antigen, it is sometimes desirable to couple the sensitizing antigen peptide to a carrier protein such as albumin or keyhole limpet hemocyanin for immunization.

Alternatively, hybridomas producing a desired antibody can be prepared using DNA immunization as mentioned below. DNA immunization is an immunization method that confers immunostimulation by expressing a sensitizing antigen in an animal immunized as a result of administering a vector DNA constructed to allow expression of an antigen protein-encoding gene in the animal. As compared to conventional immunization methods in which a protein antigen is administered to animals to be immunized, DNA immunization is expected to be superior in that:

immunostimulation can be provided while retaining the structure of a membrane protein such as GPC3; and
there is no need to purify the antigen for immunization.

In order to prepare a monoclonal antibody of the present invention using DNA immunization, first, a DNA expressing a GPC3 protein is administered to an animal to be immunized. The GPC3-encoding DNA can be synthesized by known methods such as PCR. The obtained DNA is inserted into an appropriate expression vector, and then this is administered to an animal to be immunized. Preferably used expression vectors include, for example, commercially-available expression vectors such as pcDNA3.1. Vectors can be administered to an organism using conventional methods. For example, DNA immunization is performed by using a gene gun to introduce expression vector-coated gold particles into cells in the body of an animal to be immunized. Antibodies that recognized GPC3 can also be produced by the methods described in WO 2003/104453.

After immunizing a mammal as described above, an increase in the titer of a GPC3-binding antibody is confirmed in the serum. Then, immune cells are collected from the mammal, and then subjected to cell fusion. In particular, splenocytes are preferably used as immune cells.

A mammalian myeloma cell is used as a cell to be fused with the above-mentioned immunocyte. The myeloma cells preferably comprise a suitable selection marker for screening. A selection marker confers characteristics to cells for their survival (or death) under a specific culture condition. Hypoxanthine-guanine phosphoribosyltransferase deficiency (hereinafter abbreviated as HGPRT deficiency) and thymidine kinase deficiency (hereinafter abbreviated as TK deficiency) are known as selection markers. Cells with HGPRT or TK deficiency have hypoxanthine-aminopterin-thymidine sensitivity (hereinafter abbreviated as HAT sensitivity). HAT-sensitive cells cannot synthesize DNA in a HAT selection medium, and are thus killed. However, when the cells are fused with normal cells, they can continue DNA synthesis using the salvage pathway of the normal cells, and therefore they can grow even in the HAT selection medium.

HGPRT-deficient and TK-deficient cells can be selected in a medium containing 6-thioguanine, 8-azaguanine (hereinafter abbreviated as 8AG), or 5'-bromodeoxyuridine, respectively. Normal cells are killed because they incorporate these pyrimidine analogs into their DNA. Meanwhile, cells that are deficient in these enzymes can survive in the selection medium, since they cannot incorporate these pyrimidine analogs. In addition, a selection marker referred to as G418 resistance provided by the neomycin-resistant gene confers resistance to 2-deoxystreptamine antibiotics (gentamycin analogs). Various types of myeloma cells that are suitable for cell fusion are known.

For example, myeloma cells including the following cells can be preferably used:
P3(P3x63Ag8.653) (J. Immunol. (1979) 123 (4), 1548-1550); P3x63Ag8U.1 (Current Topics in Microbiology and Immunology (1978)81, 1-7); NS-1 (C. Eur. J. Immunol. (1976)6 (7), 511-519); MPC-11 (Cell (1976) 8 (3), 405-415); SP2/0 (Nature (1978) 276 (5685), 269-270); FO (J. Immunol. Methods (1980) 35 (1-2), 1-21); S194/5.XX0.BU.1 (J. Exp. Med. (1978) 148 (1), 313-323); 8210 (Nature (1979) 277 (5692), 131-133), etc.

Cell fusions between the immunocytes and myeloma cells are essentially carried out using known methods, for example, a method by Kohler and Milstein et al. (Methods Enzymol. (1981) 73: 3-46).

More specifically, cell fusion can be carried out, for example, in a conventional culture medium in the presence of a cell fusion-promoting agent. The fusion-promoting agents include, for example, polyethylene glycol (PEG) and Sendai virus (HVJ). If required, an auxiliary substance such as dimethyl sulfoxide is also added to improve fusion efficiency.

The ratio of immunocytes to myeloma cells may be determined at one's own discretion, preferably, for example, one myeloma cell for every one to ten immunocytes. Culture media to be used for cell fusions include, for example, media that are suitable for the growth of myeloma cell lines, such as RPMI1640 medium and MEM medium, and other conventional culture medium used for this type of cell culture. In addition, serum supplements such as fetal calf serum (FCS) may be preferably added to the culture medium.

For cell fusion, predetermined amounts of the above immune cells and myeloma cells are mixed well in the above culture medium. Then, a PEG solution (for example, the average molecular weight is about 1,000 to 6,000) pre-warmed to about 37° C. is added thereto at a concentration of generally 30% to 60% (w/v). This is gently mixed to produce desired fusion cells (hybridomas). Then, an appropriate culture medium mentioned above is gradually added to the cells, and this is repeatedly centrifuged to remove the supernatant. Thus, cell fusion agents and such which are unfavorable to hybridoma growth can be removed.

The hybridomas thus obtained can be selected by culture using a conventional selective medium, for example, HAT medium (a culture medium containing hypoxanthine, aminopterin, and thymidine). Cells other than the desired hybridomas (non-fused cells) can be killed by continuing culture in the above HAT medium for a sufficient period of time. Typically, the period is several days to several weeks. Then, hybridomas producing the desired antibody are screened and singly cloned by conventional limiting dilution methods.

The hybridomas thus obtained can be selected using a selection medium based on the selection marker possessed by the myeloma used for cell fusion. For example, HGPRT- or TK-deficient cells can be selected by culture using the HAT medium (a culture medium containing hypoxanthine, aminopterin, and thymidine). Specifically, when HAT-sensitive myeloma cells are used for cell fusion, cells successfully fused with normal cells can selectively proliferate in the HAT medium. Cells other than the desired hybridomas (non-fused cells) can be killed by continuing culture in the above HAT medium for a sufficient period of time. Specifically, desired hybridomas can be selected by culture for generally several days to several weeks. Then, hybridomas producing the desired antibody are screened and singly cloned by conventional limiting dilution methods.

Desired antibodies can be preferably selected and singly cloned by screening methods based on known antigen/antibody reaction. For example, a GPC3-binding monoclonal antibody can bind to GPC3 expressed on the cell surface. Such a monoclonal antibody can be screened by fluorescence activated cell sorting (FACS). FACS is a system that assesses the binding of an antibody to cell surface by analyzing cells contacted with a fluorescent antibody using laser beam, and measuring the fluorescence emitted from individual cells.

To screen for hybridomas that produce a monoclonal antibody of the present invention by FACS, GPC3-expressing cells are first prepared. Cells preferably used for screening are mammalian cells in which GPC3 is forcedly expressed. As control, the activity of an antibody to bind to cell-surface GPC3 can be selectively detected using non-transformed mammalian cells as host cells. Specifically, hybridomas producing an anti-GPC3 monoclonal antibody can be isolated by selecting hybridomas that produce an antibody which binds to cells forced to express GPC3, but not to host cells.

Alternatively, the activity of an antibody to bind to immobilized GPC3-expressing cells can be assessed based on the principle of ELISA. For example, GPC3-expressing cells are immobilized to the wells of an ELISA plate. Culture supernatants of hybridomas are contacted with the immobilized cells in the wells, and antibodies that bind to the immobilized cells are detected. When the monoclonal antibodies are derived from mouse, antibodies bound to the cells can be detected using an anti-mouse immunoglobulin antibody. Hybridomas producing a desired antibody having the antigen-binding ability are selected by the above screening, and they can be cloned by a limiting dilution method or the like.

Monoclonal antibody-producing hybridomas thus prepared can be passaged in a conventional culture medium, and stored in liquid nitrogen for a long period.

The above hybridomas are cultured by a conventional method, and desired monoclonal antibodies can be prepared from the culture supernatants. Alternatively, the hybridomas are administered to and grown in compatible mammals, and monoclonal antibodies are prepared from the ascites. The former method is suitable for preparing antibodies with high purity.

Antibodies encoded by antibody genes that are cloned from antibody-producing cells such as the above hybridomas can also be preferably used. A cloned antibody gene is inserted into an appropriate vector, and this is introduced into a host to express the antibody encoded by the gene. Methods for isolating antibody genes, inserting the genes into vectors, and transforming host cells have already been established, for example, by Vandamme et al. (Eur. J. Biochem. (1990) 192(3), 767-775). Methods for producing recombinant antibodies are also known as described below.

For example, a cDNA encoding the variable region (V region) of an anti-GPC3 antibody is prepared from hybridoma cells expressing the anti-GPC3 antibody. For this purpose, total RNA is first extracted from hybridomas. Methods used for extracting mRNAs from cells include, for example:

the guanidine ultracentrifugation method (Biochemistry (1979) 18(24), 5294-5299), and the AGPC method (Anal. Biochem. (1987) 162(1), 156-159)

Extracted mRNAs can be purified using the mRNA Purification Kit (GE Healthcare Bioscience) or such. Alternatively, kits for extracting total mRNA directly from cells, such as the QuickPrep mRNA Purification Kit (GE Healthcare Bioscience), are also commercially available. mRNAs can be prepared from hybridomas using such kits. cDNAs encoding the antibody V region can be synthesized from the prepared mRNAs using a reverse transcriptase. cDNAs can be synthesized using the AMV Reverse Transcriptase First-strand cDNA Synthesis Kit (Seikagaku Co.) or such. Furthermore, the SMART RACE cDNA amplification kit (Clontech) and the PCR-based 5'-RACE method (Proc. Natl. Acad. Sci. USA (1988) 85(23), 8998-9002; Nucleic Acids Res. (1989) 17(8), 2919-2932) can be appropriately used to synthesize and amplify cDNAs. In such a cDNA synthesis process, appropriate restriction enzyme sites described below may be introduced into both ends of a cDNA.

The cDNA fragment of interest is purified from the resulting PCR product, and then this is ligated to a vector DNA. A recombinant vector is thus constructed, and introduced into E. coli or such. After colony selection, the desired recombinant vector can be prepared from the colony-forming E. coli. Then, whether the recombinant vector has the cDNA nucleotide sequence of interest is tested by a known method such as the dideoxy nucleotide chain termination method.

The 5'-RACE method which uses primers to amplify the variable region gene is conveniently used for isolating the gene encoding the variable region. First, a 5'-RACE cDNA library is constructed by cDNA synthesis using RNAs extracted from hybridoma cells as a template. A commercially available kit such as the SMART RACE cDNA amplification kit is appropriately used to synthesize the 5'-RACE cDNA library.

The antibody gene is amplified by PCR using the prepared 5'-RACE cDNA library as a template. Primers for amplifying the mouse antibody gene can be designed based on known antibody gene sequences. The nucleotide sequences of the primers vary depending on the immunoglobulin subclass. Therefore, it is preferable that the subclass is determined in advance using a commercially available kit such as the Iso Strip mouse monoclonal antibody isotyping kit (Roche Diagnostics).

Specifically, for example, primers that allow amplification of genes encoding γ1, γ2a, γ2b, and γ3 heavy chains and κ and λ light chains are used to isolate mouse IgG-encoding genes. In general, a primer that anneals to a constant region site close to the variable region is used as a 3'-side primer to amplify an IgG variable region gene. Meanwhile, a primer attached to a 5' RACE cDNA library construction kit is used as a 5'-side primer.

PCR products thus amplified are used to reshape immunoglobulins composed of a combination of heavy and light chains. A desired antibody can be selected using the GPC3-binding activity of a reshaped immunoglobulin as an indicator. For example, when the objective is to isolate an antibody against GPC3, it is more preferred that the binding of the antibody to GPC3 is specific. A GPC3-binding antibody can be screened, for example, by the following steps:

(1) contacting a GPC3-expressing cell with an antibody comprising the V region encoded by a cDNA isolated from a hybridoma;
(2) detecting the binding of the antibody to the GPC3-expressing cell; and
(3) selecting an antibody that binds to the GPC3-expressing cell.

Methods for detecting the binding of an antibody to GPC3-expressing cells are known. Specifically, the binding of an antibody to GPC3-expressing cells can be detected by the above-described techniques such as FACS. Immobilized samples of GPC3-expressing cells are appropriately used to assess the binding activity of an antibody.

Preferred antibody screening methods that use the binding activity as an indicator also include panning methods using phage vectors. Screening methods using phage vectors are advantageous when the antibody genes are isolated from heavy-chain and light-chain subclass libraries from a polyclonal antibody-expressing cell population. Genes encoding the heavy-chain and light-chain variable regions can be linked by an appropriate linker sequence to form a single-chain Fv (scFv). Phages presenting scFv on their surface can be produced by inserting a gene encoding scFv into a phage vector. The phages are contacted with an antigen of interest. Then, a DNA encoding scFv having the binding activity of interest can be isolated by collecting phages bound to the antigen. This process can be repeated as necessary to enrich scFv having a desired binding activity.

After isolation of the cDNA encoding the V region of the anti-GPC3 antibody of interest, the cDNA is digested with restriction enzymes that recognize the restriction sites introduced into both ends of the cDNA. Preferred restriction enzymes recognize and cleave a nucleotide sequence that occurs in the nucleotide sequence of the antibody gene at a low frequency. Furthermore, a restriction site for an enzyme that produces a sticky end is preferably introduced into a vector to insert a single-copy digested fragment in the correct orientation. The cDNA encoding the V region of the anti-GPC3 antibody is digested as described above, and this is inserted into an appropriate expression vector to construct an antibody expression vector. In this case, if a gene encoding the antibody constant region (C region) and a gene encoding the above V region are fused in-frame, a chimeric antibody is obtained. Herein, "chimeric antibody" means that the origin of the constant region is different from that of the variable region. Thus, in addition to mouse/human heterochimeric antibodies, human/human allochimeric antibodies are included in the chimeric antibodies of the present invention. A chimeric antibody expression vector can be constructed by inserting the above V region gene into an expression vector that already has the constant region. Specifically, for example, a recognition sequence for a restriction enzyme that excises the above V region gene can be appropriately placed on the 5' side of an expression vector carrying a DNA encoding a desired antibody constant region (C region). A chimeric antibody expression vector is constructed by fusing in frame the two genes digested with the same combination of restriction enzymes.

To produce an anti-GPC3 monoclonal antibody, antibody genes are inserted into an expression vector so that the genes are expressed under the control of an expression regulatory region. The expression regulatory region for antibody expression includes, for example, enhancers and promoters. Furthermore, an appropriate signal sequence may be attached to the amino terminus so that the expressed antibody is secreted to the outside of cells. In the Examples described below, a peptide having the amino acid sequence MGWSCIILFLVATATGVHS (SEQ ID NO:3) is used as a signal sequence. Meanwhile, other appropriate signal sequences may be attached. The expressed polypeptide is cleaved at the carboxyl terminus of the above sequence, and the resulting polypeptide is secreted to the outside of cells as a mature polypeptide. Then, appropriate host cells are transformed with the expression vector, and recombinant cells expressing the anti-GPC3 antibody-encoding DNA are obtained.

DNAs encoding the antibody heavy chain (H chain) and light chain (L chain) are separately inserted into different expression vectors to express the antibody gene. An antibody molecule having the H and L chains can be expressed by co-transfecting the same host cell with vectors into which the H-chain and L-chain genes are respectively inserted. Alternatively, host cells can be transformed with a single expression vector into which DNAs encoding the H and L chains are inserted (see WO 94/11523).

There are various known host cell/expression vector combinations for antibody preparation by introducing isolated antibody genes into appropriate hosts. All of these expression systems are applicable to isolation of domains including antibody variable regions of the present invention. Appropriate eukaryotic cells used as host cells include animal cells, plant cells, and fungal cells. Specifically, the animal cells include, for example, the following cells: (1) mammalian cells: CHO, COS, myeloma, baby hamster kidney (BHK), HeLa, Vero, or such; (2) amphibian cells: *Xenopus* oocytes, or such; and (3) insect cells: sf9, sf21, Tn5, or such.

In addition, as a plant cell, an antibody gene expression system using cells derived from the *Nicotiana* genus such as *Nicotiana tabacum* is known. Callus cultured cells can be appropriately used to transform plant cells.

Furthermore, the following cells can be used as fungal cells: yeasts: the *Saccharomyces* genus such as *Saccharomyces cerevisiae*, and the *Pichia* genus such as *Pichia pastoris*; and filamentous fungi: the *Aspergillus* genus such as *Aspergillus niger*.

Furthermore, antibody gene expression systems that utilize prokaryotic cells are also known. For example, when using bacterial cells, *E. coli* cells, *Bacillus subtilis* cells, and such can suitably be utilized in the present invention. Expression vectors carrying the antibody genes of interest are introduced into these cells by transfection. The transfected cells are cultured in vitro, and the desired antibody can be prepared from the culture of transformed cells.

In addition to the above-described host cells, transgenic animals can also be used to produce a recombinant antibody. That is, the antibody can be obtained from an animal into which the gene encoding the antibody of interest is introduced. For example, the antibody gene can be constructed as a fusion gene by inserting in frame into a gene that encodes a protein produced specifically in milk. Goat β-casein or such can be used, for example, as the protein secreted in milk. DNA fragments containing the fused gene inserted with the antibody gene is injected into a goat embryo, and then this embryo is introduced into a female goat. Desired antibodies can be obtained as a protein fused with the milk protein from milk produced by the transgenic goat born from the embryo-recipient goat (or progeny thereof). In addition, to increase the volume of milk containing the desired antibody produced by the transgenic goat, hormones can be administered to the transgenic goat as necessary (Ebert, K. M. et al., Bio/Technology (1994) 12 (7), 699-702).

When an antigen-binding molecule described herein is administered to human, a domain derived from a genetically recombinant antibody that has been artificially modified to reduce the heterologous antigenicity against human and such, can be appropriately used as the domain of the antigen-binding molecule including an antibody variable region. Such genetically recombinant antibodies include, for example, humanized antibodies. These modified antibodies are appropriately produced by known methods.

An antibody variable region used to produce a domain of an antigen-binding molecule including an antibody variable region described herein is generally formed by three complementarity-determining regions (CDRs) that are separated by four framework regions (FRs). CDR is a region that substantially determines the binding specificity of an antibody. The amino acid sequences of CDRs are highly diverse. On the other hand, the FR-forming amino acid sequences often have high identity even among antibodies with different binding specificities. Therefore, generally, the binding specificity of a certain antibody can be introduced to another antibody by CDR grafting.

A humanized antibody is also called a reshaped human antibody. Specifically, humanized antibodies prepared by grafting the CDR of a non-human animal antibody such as a mouse antibody to a human antibody and such are known. Common genetic engineering techniques for obtaining humanized antibodies are also known. Specifically, for example, overlap extension PCR is known as a method for grafting a mouse antibody CDR to a human FR. In overlap extension PCR, a nucleotide sequence encoding a mouse antibody CDR to be grafted is added to primers for synthesizing a human antibody FR. Primers are prepared for each of the four FRs. It is generally considered that when grafting a mouse CDR to a human FR, selecting a human FR that has high identity to a mouse FR is advantageous for maintaining the CDR function. That is, it is generally preferable to use a human FR comprising an amino acid sequence which has high identity to the amino acid sequence of the FR adjacent to the mouse CDR to be grafted.

Nucleotide sequences to be ligated are designed so that they will be connected to each other in frame. Human FRs are individually synthesized using the respective primers. As a result, products in which the mouse CDR-encoding DNA is attached to the individual FR-encoding DNAs are obtained. Nucleotide sequences encoding the mouse CDR of each product are designed so that they overlap with each other. Then, complementary strand synthesis reaction is conducted to anneal the overlapping CDR regions of the products synthesized using a human antibody gene as template. Human FRs are ligated via the mouse CDR sequences by this reaction.

The full length V region gene, in which three CDRs and four FRs are ultimately ligated, is amplified using primers that anneal to its 5'- or 3'-end, which are added with suitable restriction enzyme recognition sequences. An expression vector for humanized antibody can be produced by inserting the DNA obtained as described above and a DNA that encodes a human antibody C region into an expression vector so that they will ligate in frame. After the recombinant vector is transfected into a host to establish recombinant cells, the recombinant cells are cultured, and the DNA encoding the humanized antibody is expressed to produce the humanized antibody in the cell culture (see, European Patent Publication No. EP 239400 and International Patent Publication No. WO 1996/002576).

By qualitatively or quantitatively measuring and evaluating the antigen-binding activity of the humanized antibody produced as described above, one can suitably select human antibody FRs that allow CDRs to form a favorable antigen-binding site when ligated through the CDRs. Amino acid residues in FRs may be substituted as necessary, so that the CDRs of a reshaped human antibody form an appropriate antigen-binding site. For example, amino acid sequence mutations can be introduced into FRs by applying the PCR method used for grafting a mouse CDR into a human FR. More specifically, partial nucleotide sequence mutations can be introduced into primers that anneal to the FR. Nucleotide sequence mutations are introduced into the FRs synthesized by using such primers. Mutant FR sequences having the desired characteristics can be selected by measuring and evaluating the activity of the amino acid-substituted mutant antibody to bind to the antigen by the above-mentioned method (Sato, K. et al., Cancer Res. (1993) 53: 851-856).

Alternatively, desired human antibodies can be obtained by immunizing transgenic animals having the entire repertoire of human antibody genes (see WO 1993/012227; WO 1992/003918; WO 1994/002602; WO 1994/025585; WO 1996/034096; WO 1996/033735) by DNA immunization.

Furthermore, techniques for preparing human antibodies by panning using human antibody libraries are also known. For example, the V region of a human antibody is expressed as a single-chain antibody (scFv) on phage surface by the phage display method. Phages expressing an scFv that binds to the antigen can be selected. The DNA sequence encoding the human antibody V region that binds to the antigen can be determined by analyzing the genes of selected phages. The DNA sequence of the scFv that binds to the antigen is determined. An expression vector is prepared by fusing the V region sequence in frame with the C region sequence of a desired human antibody, and inserting this into an appropriate expression vector. The expression vector is introduced into cells appropriate for expression such as those described above. The human antibody can be produced by expressing the human antibody-encoding gene in the cells. These methods are already known (see WO 1992/001047; WO 1992/020791; WO 1993/006213; WO 1993/011236; WO 1993/019172; WO 1995/001438; WO 1995/015388).

A Domain Comprising an Antibody Variable Region Having Glypican 3 (GPC3)-binding Activity Herein, the phrase "a domain comprising an antibody variable region having glypican 3 (GPC3)-binding activity" refers to an antibody portion that comprises a region that specifically binds to the above-mentioned GPC3 protein, or to all or a portion of a partial peptide of the GPC3 protein, and is also complementary thereto. Domains comprising an antibody variable region may be provided from variable domains of one or a plurality of antibodies. Preferably, domains comprising an antibody variable region comprise antibody light-chain and heavy-chain variable regions (VL and VH). Suitable examples of such domains comprising antibody variable regions include "single chain Fv (scFv)", "single chain antibody", "Fv", "single chain Fv 2 (scFv2)", "Fab", "F(ab')2", etc.

A Domain Comprising an Antibody Variable Region Having T-cell Receptor Complex-binding Activity Herein, the phrase "a domain comprising an antibody variable region having T-cell receptor complex-binding activity" refers to a T-cell receptor complex-binding antibody portion that comprises a region that specifically binds to all or a portion of a T-cell receptor complex and is also complementary thereto. The T-cell receptor complex may be a T-cell receptor itself, or an adaptor molecule constituting a T-cell receptor complex along with a T-cell receptor. CD3 is suitable as an adaptor molecule.

A Domain Comprising an Antibody Variable Region that has T-cell Receptor-binding Activity Herein, the phrase "a domain comprising an antibody variable region having T-cell receptor-binding activity" refers to a T-cell receptor-binding antibody portion produced by including a region that specifically binds to all or a portion of a T-cell receptor and is also complementary thereto.

The portion of a T cell receptor to which the domain of the present invention binds may be a variable region or a constant region, but an epitope present in the constant region is preferred. Examples of the constant region sequence include the T cell receptor α chain of RefSeq Accession No. CAA26636.1 (SEQ ID NO:4), the T cell receptor β chain of RefSeq Accession No. C25777 (SEQ ID NO:5), the T cell receptor γ1 chain of RefSeq Accession No. A26659 (SEQ ID NO:6), the T cell receptor γ2 chain of RefSeq Accession No. AAB63312.1 (SEQ ID NO:7), and the T cell receptor δ chain of RefSeq Accession No. AAA61033.1 (SEQ ID NO:8).

A Domain Comprising an Antibody Variable Region that has CD3-binding Activity

Herein, the phrase "a domain comprising an antibody variable region that has CD3-binding activity" refers to a CD3-binding antibody portion produced by including a region that specifically binds to all or a portion of CD3 and is also complementary thereto. Preferably, the domain comprises the light-chain and heavy-chain variable regions (VL and VH) of an anti-CD3 antibody. Suitable examples of such a domain include "single chain Fv (scFv)", "single chain antibody", "Fv", "single chain Fv 2 (scFv2)", "Fab", "F(ab')2", etc.

The domain comprising an antibody variable region that has CD3-binding activity of the present invention may be any epitope-binding domain as long as the epitope exists in the γ-chain, δ-chain, or ε-chain sequence that constitutes human CD3. In the present invention, preferably, a domain comprising an anti-CD3 antibody light-chain variable region (VL) and an anti-CD3 antibody heavy-chain variable region (VH) that bind to an epitope present in the extracellular region of the ε chain of the human CD3 complex is suitably used. Besides the anti-CD3 antibody light chain variable region (VL) and anti-CD3 antibody heavy chain variable region (VH) described in the Examples, various known CD3-binding domains containing a CD3-binding antibody light chain variable region (VL) and a CD3-binding antibody heavy chain variable region (VH), and those of the OKT3 antibody (Proc. Natl. Acad. Sci. USA (1980) 77, 4914-4917) are suitably used as such domains. One may appropriately use an antibody variable region-containing domain derived from the anti-CD3 antibody having desired properties, which is obtained by immunizing a desired animal by the above-mentioned method using the γ-chain, δ-chain, or ε-chain constituting the human CD3. Human antibodies and properly humanized antibodies as described above may be appropriately used as the anti-CD3 antibody to give rise to the domain containing the antibody variable region having CD3-binding activity. Regarding the structure of the γ-chain, δ-chain, or ε-chain constituting CD3, their polynucleotide sequences are shown in SEQ ID NOs: 9 (NM_000073.2), 10 (NM_000732.4), and 11 (NM_000733.3), and their polypeptide sequences are shown in SEQ ID NOs: 12 (NP_000064.1), 13 (NP_000723.1), and 14 (NP_000724.1) (the RefSeq accession number is shown in parentheses).

Antibody variable region-containing domains in antigen binding molecules of the present invention may bind to the same epitope. Herein, the same epitope may be present in a protein comprising the amino acid sequence of SEQ ID NO:2 or 14. Alternatively, antibody variable region-containing domains in antigen binding molecules of the present invention may bind to different epitopes, respectively. Herein, the different epitopes may be present in a protein comprising the amino acid sequence of SEQ ID NO:2 or 14.

Specific

The term "specific" means that one of molecules involved in specific binding does not show any significant binding to molecules other than a single or a number of binding partner molecules. Furthermore, the term is also used when a domain containing an antibody variable region is specific to a particular epitope among multiple epitopes in an antigen. When an epitope bound by a domain containing an antibody variable region is included in a number of different antigens, antigen-binding molecules comprising the antibody variable region-containing domain can bind to various antigens that have the epitope.

Epitope

"Epitope" means an antigenic determinant in an antigen, and refers to an antigen site to which a domain of an antigen-binding molecule including an antibody variable region disclosed herein binds. Thus, for example, the epitope can be defined according to its structure. Alternatively, the epitope may be defined according to the antigen-binding activity of an antigen-binding molecule that recognizes the epitope. When the antigen is a peptide or polypeptide, the epitope can be specified by the amino acid residues forming the epitope. Alternatively, when the epitope is a sugar chain, the epitope can be specified by its specific sugar chain structure.

A linear epitope is an epitope that contains an epitope whose primary amino acid sequence is recognized. Such a linear epitope typically contains at least three and most commonly at least five, for example, about 8 to 10 or 6 to 20 amino acids in its specific sequence.

In contrast to the linear epitope, "conformational epitope" is an epitope in which the primary amino acid sequence containing the epitope is not the only determinant of the recognized epitope (for example, the primary amino acid sequence of a conformational epitope is not necessarily recognized by an epitope-defining antibody). Conformational epitopes may contain a greater number of amino acids compared to linear epitopes. A conformational epitope-recognizing antibody recognizes the three-dimensional structure of a peptide or protein. For example, when a protein molecule folds and forms a three-dimensional structure, amino acids and/or polypeptide main chains that form a conformational epitope become aligned, and the epitope is made recognizable by the antibody. Methods for determining epitope conformations include, for example, X ray crystallography, two-dimensional nuclear magnetic resonance, site-specific spin labeling, and electron paramagnetic resonance, but are not limited thereto. See, for example, Epitope Mapping Protocols in Methods in Molecular Biology (1996), Vol. 66, Morris (ed.).

A method for confirming binding to an epitope by a test antigen-binding molecule comprising a domain that contains an antibody variable region having GPC3-binding activity is exemplified below, and a method for confirming binding to an epitope by a test antigen-binding molecule comprising a domain that contains an antibody variable region having T-cell receptor complex-binding activity may also be performed suitably according to the examples below.

For example, recognition of a linear epitope present in the GPC3 molecule by a test antigen-binding molecule comprising a domain that contains an antibody variable region having GPC3-binding activity can be confirmed below. A linear peptide comprising the amino acid sequence constituting the extracellular domain of GPC3 is synthesized for the above-mentioned objective. The peptide may be synthesized chemically. Alternatively, it can be obtained by genetic engineering methods using a region in the cDNA of GPC3 that encodes an amino acid sequence corresponding to the extracellular domain. Next, the binding activity between a linear peptide comprising the amino acid sequence constituting the extracellular domain and the test antigen-binding molecule comprising a domain that contains an antibody variable region having GPC3-binding activity is evaluated. For example, ELISA which uses an immobilized linear peptide as the antigen may enable evaluation of the binding activity of the antigen-binding molecule towards the peptide. Alternatively, binding activity towards the linear peptide may be elucidated based on the level of inhibition caused by the linear peptide in the binding of the antigen-binding molecule to GPC3-expressing cells. These tests may elucidate the binding activity of the antigen-binding molecules toward the linear peptide.

Furthermore, recognition of the three-dimensional structure of the epitope by a test antigen-binding molecule comprising a domain that contains an antibody variable region having GPC3-binding activity can be confirmed below. GPC3-expressing cells are prepared for the above-mentioned objective. For example, when the test antigen-binding molecule comprising a domain that contains an antibody variable region having GPC3-binding activity contacts GPC3-expressing cells, it binds strongly to the cells, but on the other hand, there are cases when the antigen-binding molecule does not substantially bind to the immobilized linear peptide comprising the amino acid sequence constituting the extracellular domain of GPC3. In these cases, "does not substantially bind" refers to a binding activity of 80% or less, generally 50% or less, preferably 30% or less, and particularly preferably 15% or less relative to the binding activity towards human GPC3-expressing cells.

Methods for assaying the binding activity of a test antigen-binding molecule containing a GPC3 antigen-binding domain towards GPC3-expressing cells include, for example, the methods described in Antibodies: A Laboratory Manual (Ed Harlow, David Lane, Cold Spring Harbor Laboratory (1988) 359-420). Specifically, the assessment can be performed based on the principle of ELISA or fluorescence activated cell sorting (FACS) using GPC3-expressing cells as antigen.

In the ELISA format, the binding activity of a test antigen-binding molecule containing a GPC3 antigen-binding domain towards GPC3-expressing cells can be assessed quantitatively by comparing the levels of signal generated by enzymatic reaction. Specifically, a test antigen-binding molecule is added to an ELISA plate onto which GPC3-expressing cells are immobilized. Then, the test antigen-binding molecule bound to the cells is detected using an enzyme-labeled antibody that recognizes the test antigen-binding molecule. Alternatively, when FACS is used, a dilution series of a test antigen-binding molecule is prepared, and the antibody binding titer for GPC3-expressing cells can be determined to compare the binding activity of the test antigen-binding molecule towards GPC3-expressing cells.

The binding of a test antigen-binding molecule towards an antigen expressed on the surface of cells suspended in buffer or the like can be detected using a flow cytometer. Known flow cytometers include, for example, the following devices: FACSCanto™ II; FACSAria™; FACSArray™; FACSVantage™ SE; FACSCalibur™ (all are trade names of BD Biosciences); EPICS ALTRA HyPerSort; Cytomics FC 500; EPICS XL-MCL ADC EPICS XL ADC; Cell Lab Quanta/Cell Lab Quanta SC (all are trade names of Beckman Coulter)

Preferable methods for assaying the binding activity of a test antigen-binding molecule containing a GPC3 antigen-binding domain towards an antigen include, for example, the following method. First, GPC3-expressing cells are reacted with a test antigen-binding molecule, and then this is stained with an FITC-labeled secondary antibody that recognizes the polypeptide complex. The test antigen-binding molecule is appropriately diluted with a suitable buffer to prepare the complex at a desired concentration. For example, the complex can be used at a concentration within the range of 10 µg/ml to 10 ng/ml. Then, the fluorescence intensity and cell count are determined using FACSCalibur (BD). The fluorescence intensity obtained by analysis using the CELL QUEST Software (BD), i.e., the Geometric Mean value, reflects the quantity of antibody bound to cells. That is, the binding activity of a test antigen-binding molecule, which is represented by the quantity of the test antigen-binding molecule bound, can be determined by measuring the Geometric Mean value.

Whether a test antigen-binding molecule containing a GPC3 antigen-binding domain shares a common epitope with another antigen-binding molecule can be assessed based on the competition between the two complexes for the same epitope. The competition between antigen-binding molecules can be detected by cross-blocking assay or the like. For example, the competitive ELISA assay is a preferred cross-blocking assay.

Specifically, in cross-blocking assay, the GPC3 protein immobilized to the wells of a microtiter plate is pre-incubated in the presence or absence of a candidate competitor antigen-binding molecule, and then a test antigen-binding molecule is added thereto. The quantity of test antigen-binding molecule bound to the GPC3 protein in the wells is indirectly correlated with the binding ability of a candidate competitor antigen-binding molecule that competes for the binding to the same epitope. That is, the greater the affinity of the competitor antigen-binding molecule for the same epitope, the lower the binding activity of the test antigen-binding molecule towards the GPC3 protein-coated wells.

The quantity of the test antigen-binding molecule bound to the wells via the GPC3 protein can be readily determined by labeling the antigen-binding molecule in advance. For example, a biotin-labeled antigen-binding molecule is measured using an avidin/peroxidase conjugate and appropriate substrate. In particular, cross-blocking assay that uses enzyme labels such as peroxidase is called "competitive ELISA assay". The antigen-binding molecule can also be labeled with other labeling substances that enable detection or measurement. Specifically, radiolabels, fluorescent labels, and such are known.

When the candidate competitor antigen-binding molecule can block the binding by a test antigen-binding molecule containing a GPC3 antigen-binding domain by at least 20%, preferably at least 20 to 50%, and more preferably at least 50% compared to the binding activity in a control experiment conducted in the absence of the competitor antigen-binding molecule, the test antigen-binding molecule is determined to substantially bind to the same epitope bound by the competitor antigen-binding molecule, or compete for the binding to the same epitope.

When the structure of an epitope bound by a test antigen-binding molecule containing a GPC3 antigen-binding domain has already been identified, whether the test and control antigen-binding molecules share a common epitope can be assessed by comparing the binding activities of the two antigen-binding molecules towards a peptide prepared by introducing amino acid mutations into the peptide forming the epitope.

To measure the above binding activities, for example, the binding activities of test and control antigen-binding molecules towards a linear peptide into which a mutation is introduced are compared in the above ELISA format. Besides the ELISA methods, the binding activity towards the mutant peptide bound to a column can be determined by flowing test and control antigen-binding molecules in the column, and then quantifying the antigen-binding molecule eluted in the elution solution. Methods for adsorbing a mutant peptide to a column, for example, in the form of a GST fusion peptide, are known.

Alternatively, when the identified epitope is a conformational epitope, whether test and control antigen-binding molecules share a common epitope can be assessed by the following method. First, GPC3-expressing cells and cells expressing GPC3 with a mutation introduced into the epitope are prepared. The test and control antigen-binding molecules are added to a cell suspension prepared by suspending these cells in an appropriate buffer such as PBS. Then, the cell suspensions are appropriately washed with a buffer, and an FITC-labeled antibody that recognizes the test and control antigen-binding molecules is added thereto. The fluorescence intensity and number of cells stained with the labeled antibody are determined using FACSCalibur (BD). The test and control polypeptide complexes are appropriately diluted using a suitable buffer, and used at desired concentrations. For example, they may be used at a concentration within the range of 10 µg/ml to 10 ng/ml. The fluorescence intensity determined by analysis using the CELL QUEST Software (BD), i.e., the Geometric Mean value, reflects the quantity of labeled antibody bound to cells. That is, the binding activities of the test and control antigen-binding molecules, which are represented by the quantity of labeled antibody bound, can be determined by measuring the Geometric Mean value.

In the above method, whether an antigen-binding molecule does "not substantially bind to cells expressing mutant GPC3" can be assessed, for example, by the following method. First, the test and control antigen-binding molecules bound to cells expressing mutant GPC3 are stained with a labeled antibody. Then, the fluorescence intensity of the cells is determined. When FACSCalibur is used for fluorescence detection by flow cytometry, the determined fluorescence intensity can be analyzed using the CELL QUEST Software. From the Geometric Mean values in the presence and absence of the antigen-binding molecule, the comparison value ($\Delta$Geo-Mean) can be calculated according to the following formula to determine the ratio of increase in fluorescence intensity as a result of the binding by the antigen-binding molecule.

$$\Delta\text{Geo-Mean}=\text{Geo-Mean (in the presence of the antigen-binding molecule)}/\text{Geo-Mean (in the absence of the antigen-binding molecule)}$$

The Geometric Mean comparison value ($\Delta$Geo-Mean value for the mutant GPC3 molecule) determined by the above analysis, which reflects the quantity of a test antigen-binding molecule bound to cells expressing mutant GPC3, is compared to the $\Delta$Geo-Mean comparison value that reflects the quantity of the test antigen-binding molecule bound to GPC3-expressing cells. In this case, the concentrations of the test antigen-binding molecule used to determine the $\Delta$Geo-Mean comparison values for GPC3-expressing cells and cells expressing mutant GPC3 are particularly preferably adjusted to be equal or substantially equal. An antigen-binding molecule that has been confirmed to recognize an epitope in GPC3 is used as a control antigen-binding molecule.

If the $\Delta$Geo-Mean comparison value of a test antigen-binding molecule for cells expressing mutant GPC3 is smaller than the $\Delta$Geo-Mean comparison value of the test antigen-binding molecule for GPC3-expressing cells by at least 80%, preferably 50%, more preferably 30%, and particularly preferably 15%, then the test polypeptide complex "does not substantially bind to cells expressing mutant GPC3". The formula for determining the Geo-Mean (Geometric Mean) value is described in the CELL QUEST Software User's Guide (BD biosciences). When the com- Variable Fragment (Fv)

Herein, the term "variable fragment (Fv)" refers to the minimum unit of an antibody-derived antigen-binding domain that is composed of a pair of the antibody light chain variable region (VL) and antibody heavy chain variable region (VH). In 1988, Skerra and Pluckthun found that homogeneous and active antibodies can be prepared from the E. coli periplasm fraction by inserting an antibody gene downstream of a bacterial signal sequence and inducing expression of the gene in E. coli (Science (1988) 240(4855), 1038-1041). In the Fv prepared from the periplasm fraction, VH associates with VL in a manner so as to bind to an antigen.

Herein, Fv preferably includes, for example, a pair of Fv which is an antigen-binding molecule or such comprising:

(1) a bivalent antigen-binding domain which is a bivalent scFv, wherein one monovalent scFv of the bivalent scFv is linked to one polypeptide forming an Fc domain by a heavy-chain Fv fragment forming a CD3-binding domain, and the other monovalent scFv is linked to the other polypeptide forming an Fc domain by a light-chain Fv fragment forming a CD3-binding domain;

(2) a domain comprising an Fc domain that has no Fcγ receptor-binding activity, and which is derived from amino acids forming the Fc domain of IgG1, IgG2a, IgG3, or IgG4; and (3) at least a monovalent CD3-binding domain, wherein the light-chain and heavy-chain Fv fragments associate to form a CD3-binding domain such that it can bind to the CD3 antigen.

scFv, Single-chain Antibody, and Sc(Fv)2

Herein, the terms "scFv", "single-chain antibody", and "sc(Fv)2" all refer to an antibody fragment of a single polypeptide chain that contains variable regions derived from the heavy and light chains, but not the constant region. In general, a single-chain antibody also contains a polypeptide linker between the VH and VL domains, which enables formation of a desired structure that is thought to allow antigen binding. The single-chain antibody is discussed in detail by Pluckthun in "The Pharmacology of Monoclonal Antibodies, Vol. 113, Rosenburg and Moore, eds., Springer-Verlag, New York, 269-315 (1994)". See also International Patent Publication WO 1988/001649; U.S. Pat. Nos. 4,946,778 and 5,260,203. In a particular embodiment, the single-chain antibody can be bispecific and/or humanized.

scFv is an antigen-binding domain in which VH and VL forming Fv are linked together by a peptide linker (Proc. Natl. Acad. Sci. U.S.A. (1988) 85(16), 5879-5883). VH and VL can be retained in close proximity by the peptide linker.

sc(Fv)2 is a single-chain antibody in which four variable regions of two VL and two VH are linked by linkers such as peptide linkers to form a single chain (J Immunol. Methods (1999) 231(1-2), 177-189). The two VH and two VL may be derived from different monoclonal antibodies. Such sc(Fv)2 preferably includes, for example, a bispecific sc(Fv)2 that recognizes two epitopes present in a single antigen as disclosed in the Journal of Immunology (1994) 152(11), 5368-5374. sc(Fv)2 can be produced by methods known to those skilled in the art. For example, sc(Fv)2 can be produced by linking scFv by a linker such as a peptide linker.

Herein, the form of an antigen-binding domain forming an sc(Fv)2 include an antibody in which the two VH units and two VL units are arranged in the order of VH, VL, VH, and VL ([VH]-linker-[VL]-linker-[VH]-linker-[VL]) beginning from the N terminus of a single-chain polypeptide. The order of the two VH units and two VL units is not limited to the above form, and they may be arranged in any order. Example order of the form is listed below.

[VL]-linker-[VH]-linker-[VH]-linker-[VL]
[VH]-linker-[VL]-linker-[VL]-linker-[VH]
[VH]-linker-[VH]-linker-[VL]-linker-[VL]
[VL]-linker-[VL]-linker-[VH]-linker-[VH]
[VL]-linker-[VH]-linker-[VL]-linker-[VH]

The molecular form of sc(Fv)2 is also described in detail in WO 2006/132352. According to these descriptions, those skilled in the art can appropriately prepare desired sc(Fv)2 to produce the antigen-binding molecules disclosed herein.

Furthermore, the antigen-binding molecules of the present invention may be conjugated with a carrier polymer such as PEG or an organic compound such as an anticancer agent. Alternatively, a sugar chain addition sequence is preferably inserted into the polypeptide complexes such that the sugar chain produces a desired effect.

The linkers to be used for linking the variable regions of an antibody comprise arbitrary peptide linkers that can be introduced by genetic engineering, synthetic linkers, and linkers disclosed in, for example, Protein Engineering, 9(3), 299-305, 1996. However, peptide linkers are preferred in the present invention. The length of the peptide linkers is not particularly limited, and can be suitably selected by those skilled in the art according to the purpose. The length is preferably five amino acids or more (without particular limitation, the upper limit is generally 30 amino acids or less, preferably 20 amino acids or less), and particularly preferably 15 amino acids. When sc(Fv)2 contains three peptide linkers, their length may be all the same or different.

For example, such peptide linkers include:

```
Ser

Gly•Ser

Gly•Gly•Ser

Ser•Gly•Gly (SEQ ID NO: 15)
Gly•Gly•Gly•Ser (SEQ ID NO: 16)
Ser•Gly•Gly•Gly (SEQ ID NO: 17)
Gly•Gly•Gly•Gly•Ser (SEQ ID NO: 18)
Ser•Gly•Gly•Gly•Gly (SEQ ID NO: 19)
Gly•Gly•Gly•Gly•Gly•Ser (SEQ ID NO: 20)
Ser•Gly•Gly•Gly•Gly•Gly (SEQ ID NO: 21)
Gly•Gly•Gly•Gly•Gly•Gly•Ser (SEQ ID NO: 22)
Ser•Gly•Gly•Gly•Gly•Gly•Gly (Gly•Gly•Gly•Gly•Ser (SEQ ID NO: 17))n (Ser•Gly•Gly•Gly•Gly (SEQ ID NO: 18))n
``` where n is an integer of 1 or larger. The length or sequences of peptide linkers can be selected accordingly by those skilled in the art depending on the purpose.

Synthetic linkers (chemical crosslinking agents) is routinely used to crosslink peptides, and for example:
N-hydroxy succinimide (NHS),
disuccinimidyl suberate (DSS),
bis(sulfosuccinimidyl) suberate ($BS^3$),
dithiobis(succinimidyl propionate) (DSP),
dithiobis(sulfosuccinimidyl propionate) (DTSSP),
ethylene glycol bis(succinimidyl succinate) (EGS),
ethylene glycol bis(sulfosuccinimidyl succinate) (sulfo-EGS),
disuccinimidyl tartrate (DST), disulfosuccinimidyl tartrate (sulfo-DST),
bis[2-(succinimidoxycarbonyloxy)ethyl] sulfone (BSOCOES),
and bis[2-(sulfosuccinimidoxycarbonyloxy)ethyl] sulfone (sulfo-BSOCOES). These crosslinking agents are commercially available.

In general, three linkers are required to link four antibody variable regions together. The linkers to be used may be of the same type or different types.

Fab, F(ab')2, and Fab'

"Fab" consists of a single light chain, and a CH1 domain and variable region from a single heavy chain. The heavy chain of Fab molecule cannot form disulfide bonds with another heavy chain molecule.

"F(ab')2" or "Fab" is produced by treating an immunoglobulin (monoclonal antibody) with a protease such as pepsin and papain, and refers to an antibody fragment generated by digesting an immunoglobulin (monoclonal antibody) at near the disulfide bonds present between the hinge regions in each of the two H chains. For example, papain cleaves IgG upstream of the disulfide bonds present between the hinge regions in each of the two H chains to generate two homologous antibody fragments, in which an L chain comprising VL (L-chain variable region) and CL (L-chain constant region) is linked to an H-chain fragment comprising VH (H-chain variable region) and CHγ1 (γ1 region in an H-chain constant region) via a disulfide bond at their C-terminal regions. Each of these two homologous antibody fragments is called Fab'.

"F(ab')2" consists of two light chains and two heavy chains comprising the constant region of a CH1 domain and a portion of CH2 domains so that disulfide bonds are formed between the two heavy chains. The F(ab')2 forming an antigen-binding molecule disclosed herein can be preferably produced as follows. A whole monoclonal antibody or such comprising a desired antigen-binding domain is partially digested with a protease such as pepsin; and Fc fragments are removed by adsorption onto a Protein A column. The protease is not particularly limited, as long as it can cleave the whole antibody in a selective manner to produce F(ab')2 under an appropriate setup enzyme reaction condition such as pH. Such proteases include, for example, pepsin and ficin.

Fc Domain

An Fc domain that forms an antigen-binding molecule disclosed herein can be preferably produced in the following manner. An antibody such as a monoclonal antibody is partially digested with a protease such as pepsin. Then, the resulting fragment is adsorbed onto a Protein A or Protein G column, and eluted with an appropriate elution buffer. The protease is not particularly limited, as long as it can cleave antibodies such as monoclonal antibodies under an appropriate setup enzyme reaction condition such as pH. Such proteases include, for example, pepsin and ficin.

The antigen-binding molecules described herein comprise an Fc domain with reduced Fcγ receptor-binding activity, which includes amino acids forming the Fc domain of IgG1, IgG2, IgG3, or IgG4.

Antibody isotype is determined according to the structure of the constant region. Constant regions of the isotypes IgG1, IgG2, IgG3, and IgG4 are called Cγ1, Cγ2, Cγ3, and Cγ4, respectively. The amino acid sequences of Fc domain polypeptides forming human Cγ1, Cγ2, Cγ3, and Cγ4 are exemplified in SEQ ID NO:23, 24, 25, and 26, respectively. The relationship between amino acid residues forming each amino acid sequence and Kabat's EU numbering (herein also referred to as EU INDEX) are shown in FIG. 12.

The Fc domain refers to the region besides F(ab')2 which comprises two light chains and two heavy chains comprising a portion of the constant region that comprises a CH1 domain and a region between the CH1 and CH2 domains so that disulfide bonds are formed between the two heavy chains. The Fc domain forming an antigen-binding molecule disclosed herein can be preferably produced as follows. A monoclonal IgG1, IgG2, IgG3, or IgG4 antibody or the like is partially digested with a protease such as pepsin, followed by elution of the fraction adsorbed onto a Protein A column. The protease is not particularly limited, as long as it can cleave the whole antibody in a selective manner to produce F(ab')2 in an appropriate setup enzyme reaction condition such as pH. Such proteases include, for example, pepsin and ficin.

Fcγ Receptor

Fcγ receptor refers to a receptor capable of binding to the Fc domain of monoclonal IgG1, IgG2, IgG3, or IgG4 antibodies, and includes all members belonging to the family of proteins substantially encoded by an Fcγ receptor gene. In human, the family includes FcγRI (CD64) including isoforms FcγRIa, FcγRIb and FcγRIc; FcγRII (CD32) including isoforms FcγRIIa (including allotype H131 and R131), FcγRIIb (including FcγRIIb-1 and FcγRIIb-2), and FcγRIIc; and FcγRIII (CD16) including isoform FcγRIIIa (including allotype V158 and F158) and FcγRIIIb (including allotype FcγRIIIb-NA1 and FcγRIIIb-NA2); as well as all unidentified human FcγRs, FcγR isoforms, and allotypes thereof. However, Fcγ receptor is not limited to these examples. Without being limited thereto, FcγR includes those derived from humans, mice, rats, rabbits, and monkeys. FcγR may be derived from any organisms. Mouse FcγR includes, without being limited to, FcγRI (CD64), FcγRII (CD32), FcγRIII (CD16), and FcγRIII-2 (CD16-2), as well as all unidentified mouse FcγRs, FcγR isoforms, and allotypes thereof. Such preferred Fcγ receptors include, for example, human FcγRI (CD64), FcγRIIA (CD32), FcγRIIB (CD32), FcγRIIIA (CD16), and/or FcγRIIIB (CD16). The polynucleotide sequence and amino acid sequence of FcγRI are shown in SEQ ID NOs: 27 (NM_000566.3) and 28 (NP_000557.1), respectively; the polynucleotide sequence and amino acid sequence of FcγRIIA are shown in SEQ ID NOs: 29 (BC020823.1) and 30 (AAH20823.1), respectively; the polynucleotide sequence and amino acid sequence of FcγRIIB are shown in SEQ ID NOs: 31 (BC146678.1) and 32 (AAI46679.1), respectively; the polynucleotide sequence and amino acid sequence of FcγRIIIA are shown in SEQ ID NOs: 33 (BC033678.1) and 34 (AAH33678.1), respectively; and the polynucleotide sequence and amino acid sequence of FcγRIIIB are shown in SEQ ID NOs: 35 (BC128562.1) and 36 (AAI28563.1), respectively (RefSeq accession number is shown in each parentheses). Whether an Fcγ receptor has binding activity to the Fc domain of a monoclonal IgG1, IgG2, IgG3, or IgG4 antibody can be assessed by ALPHA screen (Amplified Luminescent Proximity Homogeneous Assay), surface plasmon resonance (SPR)-based BIACORE method, and others (Proc. Natl. Acad. Sci. USA (2006) 103(11), 4005-4010), in addition to the above-described FACS and ELISA formats.

Meanwhile, "Fc ligand" or "effector ligand" refers to a molecule and preferably a polypeptide that binds to an antibody Fc domain, forming an Fc/Fc ligand complex. The molecule may be derived from any organisms. The binding of an Fc ligand to Fc preferably induces one or more effector functions. Such Fc ligands include, but are not limited to, Fc receptors, FcγR, FcαR, FcεR, FcRn, C1q, and C3, mannan-binding lectin, mannose receptor, *Staphylococcus* Protein A, *Staphylococcus* Protein G, and viral FcγRs. The Fc ligands also include Fc receptor homologs (FcRH) (Davis et al., (2002) Immunological Reviews 190, 123-136), which are a family of Fc receptors homologous to FcγR. The Fc ligands also include unidentified molecules that bind to Fc.

Fcγ Receptor-binding Activity

The impaired binding activity of Fc domain to any of the Fcγ receptors FcγI, FcγIIA, FcγIIB, FcγIIIA, and/or FcγIIIB can be assessed by using the above-described FACS and ELISA formats as well as ALPHA screen (Amplified Luminescent Proximity Homogeneous Assay) and surface plasmon resonance (SPR)-based BIACORE method (Proc. Natl. Acad. Sci. USA (2006) 103(11), 4005-4010).

ALPHA screen is performed by the ALPHA technology based on the principle described below using two types of beads: donor and acceptor beads. A luminescent signal is detected only when molecules linked to the donor beads interact biologically with molecules linked to the acceptor beads and when the two beads are located in close proximity. Excited by laser beam, the photosensitizer in a donor bead converts oxygen around the bead into excited singlet oxygen. When the singlet oxygen diffuses around the donor beads and reaches the acceptor beads located in close proximity, a chemiluminescent reaction within the acceptor beads is induced. This reaction ultimately results in light emission. If molecules linked to the donor beads do not interact with molecules linked to the acceptor beads, the singlet oxygen produced by donor beads do not reach the acceptor beads and chemiluminescent reaction does not occur.

For example, a biotin-labeled antigen-binding molecule is immobilized to the donor beads and glutathione S-transferase (GST)-tagged Fcγ receptor is immobilized to the acceptor beads. In the absence of an antigen-binding molecule comprising a competitive mutant Fc domain, Fcγ receptor interacts with an antigen-binding molecule comprising a wild-type Fc domain, inducing a signal of 520 to 620 nm as a result. The antigen-binding molecule having a non-tagged mutant Fc domain competes with the antigen-binding molecule comprising a wild-type Fc domain for the interaction with Fcγ receptor. The relative binding affinity can be determined by quantifying the reduction of fluorescence as a result of competition. Methods for biotinylating antigen-binding molecules such as antibodies using Sulfo-NHS-biotin or the like are known. Appropriate methods for adding the GST tag to an Fcγ receptor include methods that involve fusing polypeptides encoding Fcγ and GST in-frame, expressing the fused gene using cells introduced with a vector carrying the gene, and then purifying using a glutathione column. The induced signal can be preferably analyzed, for example, by fitting to a one-site competition model based on nonlinear regression analysis using software such as GRAPHPAD PRISM (GraphPad; San Diego).

One of the substances for observing their interaction is immobilized as a ligand onto the gold thin layer of a sensor chip. When light is shed on the rear surface of the sensor chip so that total reflection occurs at the interface between the gold thin layer and glass, the intensity of reflected light is partially reduced at a certain site (SPR signal). The other substance for observing their interaction is injected as an analyte onto the surface of the sensor chip. The mass of immobilized ligand molecule increases when the analyte binds to the ligand. This alters the refraction index of solvent on the surface of the sensor chip. The change in refraction index causes a positional shift of SPR signal (conversely, the dissociation shifts the signal back to the original position). In the Biacore system, the amount of shift described above (i.e., the change of mass on the sensor chip surface) is plotted on the vertical axis, and thus the change of mass over time is shown as measured data (sensorgram). Kinetic parameters (association rate constant (ka) and dissociation rate constant (kd)) are determined from the curve of sensorgram, and affinity (KD) is determined from the ratio between these two constants. Inhibition assay is preferably used in the BIACORE methods. Examples of such inhibition assay are described in Proc. Natl. Acad. Sci. USA (2006) 103(11), 4005-4010.

Herein, "Fcγ receptor-binding activity is reduced" means, for example, that based on the above-described analysis method the competitive activity of a test antigen-binding molecule is 50% or less, preferably 45% or less, 40% or less, 35% or less, 30% or less, 20% or less, or 15% or less, and particularly preferably 10% or less, 9% or less, 8% or less, 7% or less, 6% or less, 5% or less, 4% or less, 3% or less, 2% or less, or 1% or less than the competitive activity of a control antigen-binding molecule.

Antigen-binding molecules comprising the Fc domain of a monoclonal IgG1, IgG2, IgG3, or IgG4 antibody can be appropriately used as control antigen-binding molecules. The Fc domain structures are shown in SEQ ID NOs: 37 (A is added to the N terminus of RefSeq accession number AAC82527.1), 38 (A is added to the N terminus of RefSeq accession number AAB59393.1), 25 (A is added to the N terminus of RefSeq accession number CAA27268.1), and 39 (A is added to the N terminus of RefSeq accession number AAB59394.1). Furthermore, when an antigen-binding molecule comprising an Fc domain mutant of an antibody of a particular isotype is used as a test substance, the effect of the mutation of the mutant on the Fcγ receptor-binding activity is assessed using as a control an antigen-binding molecule comprising an Fc domain of the same isotype. As described above, antigen-binding molecules comprising an Fc domain mutant whose Fcγ receptor-binding activity has been judged to be reduced are appropriately prepared.

Such known mutants include, for example, mutants having a deletion of amino acids 231A-238S (EU numbering) (WO 2009/011941), as well as mutants C226S, C229S, P238S, (C220S) (J. Rheumatol (2007) 34, 11); C226S and C229S (Hum. Antibod. Hybridomas (1990) 1(1), 47-54); C226S, C229S, E233P, L234V, and L235A (Blood (2007) 109, 1185-1192).

Specifically, the preferred antigen-binding molecules include those comprising an Fc domain with a substitution of the amino acid at position 220, 226, 229, 231, 232, 233, 234, 235, 236, 237, 238, 239, 240, 264, 265, 266, 267, 269, 270, 295, 296, 297, 298, 299, 300, 325, 327, 328, 329, 330, 331, or 332 (EU numbering) in the amino acids forming the Fc domain of an antibody of a particular isotype. The isotype of antibody from which the Fc domain originates is not particularly limited, and it is possible to use an appropriate Fc domain derived from a monoclonal IgG1, IgG2, IgG3, or IgG4 antibody. It is preferable to use Fc domains derived from IgG1 antibodies.

The preferred antigen-binding molecules include, for example, those comprising an Fc domain which has any one of the substitutions shown below, whose positions are specified according to EU numbering (each number represents the position of an amino acid residue in the EU numbering; and the one-letter amino acid symbol before the number represents the amino acid residue before substitution, while the one-letter amino acid symbol after the number represents the amino acid residue before the substitution) in the amino acids forming the Fc domain of IgG1 antibody:

(a) L234F, L235E, P331S;
(b) C226S, C229S, P238S;
(c) C226S, C229S;
(d) C226S, C229S, E233P, L234V, L235A;
(e) L234A, L235A or L235R, N297A;
(f) L235A or L235R, S239K, N297A
as well as those having an Fc domain which has a deletion of the amino acid sequence at positions 231 to 238.

Furthermore, the preferred antigen-binding molecules also include those comprising an Fc domain that has any one of the substitutions shown below, whose positions are specified according to EU numbering in the amino acids forming the Fc domain of an IgG2 antibody:

(g) H268Q, V309L, A330S, and P331S;
(h) V234A;
(i) G237A;
(j) V234A and G237A;
(k) A235E and G237A;
(l) V234A, A235E, and G237A. Each number represents the position of an amino acid residue in EU numbering; and the one-letter amino acid symbol before the number represents the amino acid residue before substitution, while the one-letter amino acid symbol after the number represents the amino acid residue before the substitution.

Furthermore, the preferred antigen-binding molecules also include those comprising an Fc domain that has any one of the substitutions shown below, whose positions are specified according to EU numbering in the amino acids forming the Fc domain of an IgG3 antibody:

(m) F241A;
(n) D265A;
(o) V264A. Each number represents the position of an amino acid residue in EU numbering; and the one-letter amino acid symbol before the number represents the amino acid residue before substitution, while the one-letter amino acid symbol after the number represents the amino acid residue before the substitution.

Furthermore, the preferred antigen-binding molecules also include those comprising an Fc domain that has any one of the substitutions shown below, whose positions are specified according to EU numbering in the amino acids forming the Fc domain of an IgG4 antibody:

(p) L235A, G237A, and E318A;
(q) L235E;
(r) F234A and L235A. Each number represents the position of an amino acid residue in EU numbering; and the one-letter amino acid symbol before the number represents the amino acid residue before substitution, while the one-letter amino acid symbol after the number represents the amino acid residue before the substitution.

The other preferred antigen-binding molecules include, for example, those comprising an Fc domain in which any amino acid at position 233, 234, 235, 236, 237, 327, 330, or 331 (EU numbering) in the amino acids forming the Fc domain of an IgG1 antibody is substituted with an amino acid of the corresponding position in EU numbering in the corresponding IgG2 or IgG4.

The preferred antigen-binding molecules also include, for example, those comprising an Fc domain in which any one or more of the amino acids at positions 234, 235, and 297 (EU numbering) in the amino acids forming the Fc domain of an IgG1 antibody is substituted with other amino acids. The type of amino acid after substitution is not particularly limited; however, the antigen-binding molecules comprising an Fc domain in which any one or more of the amino acids at positions 234, 235, and 297 are substituted with alanine are particularly preferred.

The preferred antigen-binding molecules also include, for example, those comprising an Fc domain in which an amino acid at position 265 (EU numbering) in the amino acids forming the Fc domain of an IgG1 antibody is substituted with another amino acid. The type of amino acid after substitution is not particularly limited; however, antigen-binding molecules comprising an Fc domain in which an amino acid at position 265 is substituted with alanine are particularly preferred.

Multispecific Antigen-binding Molecule

Examples of a preferred embodiment of the "multispecific antigen-binding molecule" of the present invention include multispecific antibodies. When an Fc region with reduced Fcγ receptor-binding activity is used as the multispecific antibody Fc region, an Fc region derived from the multispecific antibody may be used appropriately. Bispecific antibodies are particularly preferred as the multispecific antibodies of the present invention. In this case, a bispecific antibody is an antibody having two different specificities. IgG-type bispecific antibodies can be secreted from a hybrid hybridoma (quadroma) produced by fusing two types of hybridomas that produce IgG antibodies (Milstein et al., Nature (1983) 305, 537-540).

Furthermore, IgG-type bispecific antibodies are secreted by introducing the genes of L chains and H chains constituting the two types of IgGs of interest, i.e. a total of four genes, into cells, and co-expressing them. However, the number of combinations of H and L chains of IgG that can be produced by these methods is theoretically ten combinations. Accordingly, it is difficult to purify an IgG comprising the desired combination of H and L chains from ten types of IgGs. Furthermore, theoretically the amount of secretion of the IgG having the desired combination will decrease remarkably, and therefore large-scale culturing will be necessary, and production costs will increase further.

Therefore, techniques for promoting the association among H chains and between L and H chains having the desired combinations can be applied to the multispecific antigen-binding molecules of the present invention.

For example, techniques for suppressing undesired H-chain association by introducing electrostatic repulsion at the interface of the second constant region or the third constant region of the antibody H chain (CH2 or CH3) can be applied to multispecific antibody association (WO 2006/106905).

In the technique of suppressing unintended H-chain association by introducing electrostatic repulsion at the interface of CH2 or CH3, examples of amino acid residues in contact at the interface of the other constant region of the H chain include regions corresponding to the residues at EU numbering positions 356, 439, 357, 370, 399, and 409 in the CH3 region.

More specifically, examples include an antibody comprising two types of H-chain CH3 regions, in which one to three pairs of amino acid residues in the first H-chain CH3 region, selected from the pairs of amino acid residues indicated in (1) to (3) below, carry the same type of charge: (1) amino acid residues comprised in the H chain CH3 region at EU numbering positions 356 and 439; (2) amino acid residues comprised in the H-chain CH3 region at EU numbering positions 357 and 370; and (3) amino acid residues comprised in the H-chain CH3 region at EU numbering positions 399 and 409.

Furthermore, the antibody may be an antibody in which pairs of the amino acid residues in the second H-chain CH3 region which is different from the first H-chain CH3 region mentioned above, are selected from the aforementioned pairs of amino acid residues of (1) to (3), wherein the one to three pairs of amino acid residues that correspond to the aforementioned pairs of amino acid residues of (1) to (3) carrying the same type of charges in the first H-chain CH3 region mentioned above carry opposite charges from the corresponding amino acid residues in the first H-chain CH3 region mentioned above.

Each of the amino acid residues indicated in (1) to (3) above come close to each other during association. Those skilled in the art can find out positions that correspond to the above-mentioned amino acid residues of (1) to (3) in a desired H-chain CH3 region or H-chain constant region by homology modeling and such using commercially available software, and amino acid residues of these positions can be appropriately subjected to modification.

In the antibodies mentioned above, "charged amino acid residues" are preferably selected, for example, from amino acid residues included in either one of the following groups: (a) glutamic acid (E) and aspartic acid (D); and (b) lysine (K), arginine (R), and histidine (H).

In the above-mentioned antibodies, the phrase "carrying the same charge" means, for example, that all of the two or more amino acid residues are selected from the amino acid residues included in either one of groups (a) and (b) mentioned above. The phrase "carrying opposite charges" means, for example, that when at least one of the amino acid residues among two or more amino acid residues is selected from the amino acid residues included in either one of groups (a) and (b) mentioned above, the remaining amino acid residues are selected from the amino acid residues included in the other group.

In a preferred embodiment, the antibodies mentioned above may have their first H-chain CH3 region and second H-chain CH3 region crosslinked by disulfide bonds.

In the present invention, amino acid residues subjected to modification are not limited to the above-mentioned amino acid residues of the antibody variable regions or the antibody constant regions. Those skilled in the art can identify the amino acid residues that form an interface in mutant polypeptides or heteromultimers by homology modeling and such using commercially available software; and amino acid residues of these positions can then be subjected to modification so as to regulate the association.

Other known techniques can also be used for the association of multispecific antibodies of the present invention. Fc region-containing polypeptides comprising different amino acids can be efficiently associated with each other by substituting an amino acid side chain present in one of the H-chain Fc regions of the antibody with a larger side chain (knob), and substituting an amino acid side chain present in the corresponding Fc region of the other H chain with a smaller side chain (hole) to allow placement of the knob within the hole (WO 1996/027011; Ridgway J B et al., Protein Engineering (1996) 9, 617-621; Merchant A. M. et al. Nature Biotechnology (1998) 16, 677-681; and US20130336973).

In addition, other known techniques can also be used for formation of multispecific antibodies of the present invention. Association of polypeptides having different sequences can be induced efficiently by complementary association of CH3 using a strand-exchange engineered domain CH3 produced by changing part of one of the H-chain CH3s of an antibody to a corresponding IgA-derived sequence and introducing a corresponding IgA-derived sequence into the complementary portion of the other H-chain CH3 (Protein Engineering Design & Selection, 23; 195-202, 2010). This known technique can also be used to efficiently form multispecific antibodies of interest.

In addition, technologies for antibody production using association of antibody CH1 and CL and association of VH and VL as described in WO 2011/028952, WO 2014/018572, and Nat Biotechnol. 2014 February; 32(2):191-8; technologies for producing bispecific antibodies using separately prepared monoclonal antibodies in combination (Fab Arm Exchange) as described in WO 2008/119353 and WO 2011/131746; technologies for regulating association between antibody heavy-chain CH3s as described in WO 2012/058768 and WO 2013/063702; technologies for producing bispecific antibodies composed of two types of light chains and one type of heavy chain as described in WO 2012/023053; technologies for producing bispecific antibodies using two bacterial cell strains that individually express one of the chains of an antibody comprising a single H chain and a single L chain as described by Christoph et al. (Nature Biotechnology Vol. 31, p 753-758 (2013)); and such may be used for the formation of multispecific antibodies.

Alternatively, even when a multispecific antibody of interest cannot be formed efficiently, a multispecific antibody of the present invention can be obtained by separating and purifying the multispecific antibody of interest from the produced antibodies. For example, a method for enabling purification of two types of homomeric forms and the heteromeric antibody of interest by ion-exchange chromatography by imparting a difference in isoelectric points by introducing amino acid substitutions into the variable regions of the two types of H chains has been reported (WO 2007/114325). To date, as a method for purifying heteromeric antibodies, methods using Protein A to purify a heterodimeric antibody comprising a mouse IgG2a H chain that binds to Protein A and a rat IgG2b H chain that does not bind to Protein A have been reported (WO 1998/050431 and WO 1995/033844). Furthermore, a heterodimeric antibody can be purified efficiently on its own by using H chains comprising substitution of amino acid residues at EU numbering positions 435 and 436, which is the IgG-Protein A binding site, with Tyr, His, or such which are amino acids that yield a different Protein A affinity, or using H chains with a different protein A affinity obtained according to the method of Reference Example 5, to change the interaction of each of the H chains with Protein A, and then using a Protein A column.

Alternatively, a common L chain that can provide binding ability to a plurality of different H chains can be obtained and used as the common L chain of a multispecific antibody. Efficient expression of a multispecific IgG can be achieved by introducing the genes of such a common L chain and a plurality of different H chains into cells to express the IgG (Nature Biotechnology (1998) 16, 677-681). A method for selecting a common L chain that shows a strong binding ability to any of the different H chains can also be used when selecting the common H chain (WO 2004/065611).

Furthermore, an Fc region whose Fc region C-terminal heterogeneity has been improved can be appropriately used as an Fc region of the present invention. More specifically, the present invention provides Fc regions produced by deleting glycine at position 446 and lysine at position 447 as specified by EU numbering from the amino acid sequences of two polypeptides constituting an Fc region derived from IgG1, IgG2, IgG3, or IgG4.

A plurality, such as two or more, of these technologies can be used in combination. Furthermore, these technologies can be appropriately and separately applied to the two H chains to be associated. Furthermore, these techniques can be used in combination with the above-mentioned Fc region which has reduced binding activity to an Fcγ receptor. Furthermore, an antigen-binding molecule of the present invention may be a molecule produced separately so that it has the same amino acid sequence, based on the antigen-binding molecule subjected to the above-described modifications.

An appropriate multispecific antigen-binding molecule of the present invention comprises
(1) a domain comprising an antibody variable region having glypican 3-binding activity;
(2) a domain comprising an antibody variable region having T-cell receptor complex-binding activity; and
(3) a domain comprising an Fc region with reduced Fcγ receptor-binding activity mentioned above, without limitation to its structure.

In the present invention, each of the above-mentioned domains can be linked directly by peptide bonds. For example, when using F(ab')₂ as the domain comprising an antibody variable region of (1) and (2), and these Fc regions as the domain comprising an Fc region with reduced Fcγ receptor-binding activity of (3), the polypeptides formed by linking the antibody variable region-containing domains of (1) and (2) and the Fc region-containing domain of (3) by peptide bonds will form an antibody structure. Such antibodies can be produced by purification from the above-mentioned hybridoma culture medium, and also by purifying antibodies from the culture medium of desired host cells that stably carry polynucleotides encoding the polypeptides constituting the antibody.

Examples of a preferred antibody H-chain variable region of the present invention contained in the antibody variable region having glypican 3-binding activity comprises the antibody H-chain variable regions of Table 1, or antibody H-chain variable regions having CDR sequences whose CDR1, CDR2, and CDR3 amino acid sequences are the same as the CDR1, CDR2, and CDR3 amino acid sequences contained in the H-chain variable regions of Table 1, or antibody H-chain variable regions which are functionally equivalent to the above-mentioned variable regions.

TABLE 1

| Sequence Name | SEQ ID NO: |
| --- | --- |
| H0000 | 40 |
| GCH003 | 170 |
| GCH005 | 171 |
| GCH006 | 172 |
| GCH007 | 173 |
| GCH008 | 174 |
| GCH010 | 175 |
| GCH012 | 176 |
| GCH013 | 177 |
| GCH014 | 178 |

TABLE 1-continued

| Sequence Name | SEQ ID NO: |
| --- | --- |
| GCH015 | 179 |
| GCH016 | 180 |
| GCH019 | 181 |
| GCH022 | 182 |
| GCH023 | 183 |
| GCH025 | 184 |
| GCH026 | 185 |
| GCH027 | 186 |
| GCH029 | 187 |
| GCH032 | 188 |
| GCH034 | 189 |
| GCH035 | 190 |
| GCH039 | 191 |
| GCH040 | 192 |
| GCH042 | 193 |
| GCH043 | 194 |
| GCH045 | 195 |
| GCH053 | 196 |
| GCH054 | 197 |
| GCH055 | 198 |
| GCH056 | 199 |
| GCH057 | 200 |
| GCH059 | 201 |
| GCH060 | 202 |
| GCH061 | 203 |
| GCH062 | 204 |
| GCH064 | 205 |
| GCH065 | 206 |
| GCH066 | 207 |
| GCH067 | 208 |
| GCH068 | 209 |
| GCH073 | 210 |
| GCH094 | 211 |
| GCH098 | 212 |
| GCH099 | 213 |
| GCH100 | 214 |
| H0610 | 215 |

Examples of a preferred antibody variable region having T-cell receptor complex-binding activity of the present invention include antibody variable regions having T-cell receptor-binding activity. Of the T-cell receptors, CD3 is preferred, and CD3ε is particularly preferred. Examples of an antibody H-chain variable region contained in such antibody variable regions include the antibody H-chain variable regions of Table 2, antibody H-chain variable regions having CDR sequences whose CDR1, CDR2, and CDR3 amino acid sequences are the same as the CDR1, CDR2, and CDR3 amino acid sequences contained in the antibody H-chain variable regions of Table 2, and antibody H-chain variable regions that are functionally equivalent to the above-mentioned variable regions.

TABLE 2

| Sequence Name | SEQ ID NO: |
| --- | --- |
| hCE115HA | 52 |
| CE115HA177 | 64 |
| CE115HA178 | 65 |
| CE115HA179 | 66 |
| CE115HA180 | 67 |
| hCE115HAa | 68 |
| TR01H006 | 69 |
| TR01H007 | 70 |
| TR01H008 | 71 |
| TR01H009 | 72 |
| TR01H010 | 73 |
| TR01H011 | 74 |
| TR01H012 | 75 |
| TR01H013 | 76 |
| TR01H014 | 77 |
| TR01H015 | 78 |

TABLE 2-continued

| Sequence Name | SEQ ID NO: |
|---|---|
| TR01H016 | 79 |
| TR01H017 | 80 |
| TR01H018 | 81 |
| TR01H019 | 82 |
| TR01H020 | 83 |
| TR01H021 | 84 |
| TR01H022 | 85 |
| TR01H023 | 86 |
| TR01H024 | 87 |
| TR01H025 | 88 |
| TR01H026 | 89 |
| TR01H027 | 90 |
| TR01H028 | 91 |
| TR01H029 | 92 |
| TR01H030 | 93 |
| TR01H031 | 94 |
| TR01H032 | 95 |
| TR01H033 | 96 |
| TR01H034 | 97 |
| TR01H035 | 98 |
| TR01H036 | 99 |
| TR01H037 | 100 |
| TR01H038 | 101 |
| TR01H039 | 102 |
| TR01H040 | 103 |
| TR01H041 | 104 |
| TR01H042 | 105 |
| TR01H043 | 106 |
| TR01H044 | 107 |
| TR01H045 | 108 |
| TR01H046 | 109 |
| TR01H047 | 110 |
| TR01H048 | 111 |
| TR01H049 | 112 |
| TR01H050 | 113 |
| TR01H051 | 114 |
| TR01H052 | 115 |
| TR01H053 | 116 |
| TR01H054 | 117 |
| TR01H055 | 118 |
| TR01H056 | 119 |
| TR01H057 | 120 |
| TR01H058 | 121 |
| TR01H061 | 122 |
| TR01H062 | 123 |
| TR01H063 | 124 |
| TR01H064 | 125 |
| TR01H065 | 126 |
| TR01H066 | 127 |
| TR01H067 | 128 |
| TR01H068 | 129 |
| TR01H069 | 130 |
| TR01H070 | 131 |
| TR01H071 | 132 |
| TR01H072 | 133 |
| TR01H073 | 134 |
| TR01H074 | 135 |
| TR01H075 | 136 |
| TR01H076 | 137 |
| TR01H077 | 138 |
| TR01H079 | 139 |
| TR01H080 | 140 |
| TR01H081 | 141 |
| TR01H082 | 142 |
| TR01H083 | 143 |
| TR01H084 | 144 |
| TR01H090 | 145 |
| TR01H091 | 146 |
| TR01H092 | 147 |
| TR01H093 | 148 |
| TR01H094 | 149 |
| TR01H095 | 150 |
| TR01H096 | 151 |
| TR01H097 | 152 |
| TR01H098 | 153 |
| TR01H099 | 154 |
| TR01H100 | 155 |
| TR01H101 | 156 |
| TR01H102 | 157 |
| TR01H103 | 158 |
| TR01H104 | 159 |
| TR01H105 | 160 |
| TR01H106 | 161 |
| TR01H107 | 162 |
| TR01H108 | 163 |
| TR01H109 | 164 |
| TR01H110 | 165 |
| TR01H111 | 166 |
| TR01H112 | 167 |
| TR01H113 | 168 |
| TR01H114 | 169 |
| TR01H001 | 420 |
| TR01H002 | 421 |
| TR01H003 | 422 |
| TR01H004 | 423 |
| rCE115H | 424 |
| CE115HA121 | 425 |
| CE115HA122 | 426 |
| CE115HA124 | 427 |
| CE115HA192 | 428 |
| CE115HA236 | 429 |
| CE115HA251 | 430 |
| CE115HA252 | 431 |

The relationship between the CDR regions of the amino acid residues constituting the antibody H chain amino acid sequence and Kabat numbering is as shown in FIG. 13-1 and FIG. 13-2.

For the antibody L-chain variable regions contained in the antibody variable region having glypican 3-binding activity and the antibody variable region having T-cell receptor complex-binding activity of the present invention, it is preferable to obtain a common L chain that may provide a binding activity to the H chain having glypican 3-binding activity and a binding activity to the H chain having T-cell receptor complex, and to use this as the common L-chain variable region of the multispecific antigen-binding molecule.

Examples of the common L-chain variable region to be used in the present invention include the L-chain variable regions of Table 3, antibody L-chain variable regions having CDR sequences whose CDR1, CDR2, and CDR3 amino acid sequences are the same as the CDR1, CDR2, and CDR3 amino acid sequences contained in the antibody L-chain variable regions of Table 3, and antibody L-chain variable regions that are functionally equivalent to the above-mentioned variable regions.

TABLE 3

| Sequence Name | SEQ ID NO: |
|---|---|
| L0000 | 53 |
| L0002 | 217 |
| L0003 | 218 |
| L0006 | 219 |
| L0007 | 220 |
| L0008 | 221 |
| L0009 | 222 |
| L0011 | 223 |
| L0012 | 224 |
| L0013 | 225 |
| L0014 | 226 |
| L0015 | 227 |
| L0016 | 228 |
| L0032 | 229 |
| L0038 | 230 |
| L0039 | 231 |
| L0041 | 232 |

TABLE 3-continued

| Sequence Name | SEQ ID NO: |
|---|---|
| L0042 | 233 |
| L0043 | 234 |
| L0044 | 235 |
| L0045 | 236 |
| L0046 | 237 |
| L0047 | 238 |
| L0062 | 239 |
| L0063 | 240 |
| L0064 | 241 |
| L0065 | 242 |
| L0066 | 243 |
| L0069 | 244 |
| L0075 | 245 |
| L0079 | 246 |
| L0082 | 247 |
| L0085 | 248 |
| L0089 | 249 |
| L0090 | 250 |
| L0091 | 251 |
| L0093 | 252 |
| L0104 | 253 |
| L0106 | 254 |
| L0107 | 255 |
| L0109 | 256 |
| L0113 | 257 |
| L0115 | 258 |
| L0117 | 259 |
| L0120 | 260 |
| L0122 | 261 |
| L0123 | 262 |
| L0124 | 263 |
| L0125 | 264 |
| L0126 | 265 |
| L0127 | 266 |
| L0129 | 267 |
| L0132 | 268 |
| L0134 | 269 |
| L0136 | 270 |
| L0137 | 271 |
| L0138 | 272 |
| L0139 | 273 |
| L0140 | 274 |
| L0141 | 275 |
| L0143 | 276 |
| L0144 | 277 |
| L0145 | 278 |
| L0147 | 279 |
| L0148 | 280 |
| L0149 | 281 |
| L0151 | 282 |
| L0152 | 283 |
| L0154 | 284 |
| L0155 | 285 |
| L0157 | 286 |
| L0160 | 287 |
| L0161 | 288 |
| L0163 | 289 |
| L0167 | 290 |
| L0168 | 291 |
| L0173 | 292 |
| L0175 | 293 |
| L0180 | 294 |
| L0181 | 295 |
| L0186 | 296 |
| L0187 | 297 |
| L0200 | 298 |
| L0201 | 299 |
| L0202 | 300 |
| L0203 | 301 |
| L0204 | 302 |
| L0205 | 303 |
| L0206 | 304 |
| L0207 | 305 |
| L0208 | 306 |
| L0209 | 307 |
| L0210 | 308 |
| L0211 | 309 |
| L0212 | 310 |
| L0213 | 311 |
| L0214 | 312 |
| L0215 | 313 |
| L0216 | 314 |
| L0217 | 315 |
| L0218 | 316 |
| L0219 | 317 |
| L0220 | 318 |
| L0222 | 319 |
| L0223 | 320 |
| L0224 | 321 |
| L0226 | 322 |
| L0227 | 323 |
| L0228 | 324 |
| L0229 | 325 |
| L0230 | 326 |
| L0231 | 327 |
| L0232 | 328 |
| L0233 | 329 |
| L0234 | 330 |
| L0235 | 331 |
| L0236 | 332 |
| L0237 | 333 |
| L0238 | 334 |
| L0239 | 335 |
| L0240 | 336 |
| L0241 | 337 |
| L0242 | 338 |
| L0243 | 339 |
| L0246 | 340 |
| L0247 | 341 |
| L0248 | 342 |
| L0249 | 343 |
| L0250 | 344 |
| L0258 | 345 |
| L0259 | 346 |
| L0260 | 347 |
| L0261 | 348 |
| L0262 | 349 |
| L0263 | 350 |
| L0264 | 351 |
| L0265 | 352 |
| L0266 | 353 |
| L0267 | 354 |
| L0268 | 355 |
| L0269 | 356 |
| L0270 | 357 |
| L0271 | 358 |
| L0272 | 359 |

The relationship between the CDR regions of the amino acid residues constituting the antibody L-chain amino acid sequence and Kabat numbering is as shown in FIG. 14.

In the present invention, the phrase "functionally equivalent" means that the binding affinities for an antigen are equivalent, or alternatively, it means that the cytotoxic activities against glypican 3-expressing cells or tissues containing these cells are equivalent when it is used as a multispecific antigen-binding molecule. The binding affinity and cytotoxic activity can be measured based on the description herein. The cells used for measurement of cytotoxic activity may be the desired GPC3-expressing cells or a desired tissue containing these cells, and for example, PC-10 or NCI-H446 which are GPC3-expressing human cancer cell lines can be used. Regarding the antibody constant regions, the phrase may mean that the decreases in Fcγ receptor-binding activity are equivalent.

For example, an antibody H-chain variable region functionally equivalent to the antibody H chain variable region described herein (i.e., the original H chain variable region) means that this region has the same binding affinity when it is combined with the antibody L-chain variable region described herein which forms a pair with the original H chain, or alternatively that the region has the same cytotoxic activity towards glypican 3-expressing cells or a tissue containing these cells when used for a multispecific antigen-binding molecule. Furthermore, an antibody L-chain variable region functionally equivalent to the antibody L-chain variable region described herein (i.e., the original L-chain variable region) means that this region has the same binding affinity when it is combined with the antibody H-chain variable region described herein which forms a pair with the original L chain, or alternatively that the region has the same cytotoxic activity towards glypican 3-expressing cells or a tissue containing these cells when used for a multispecific antigen-binding molecule.

The term "equivalent" does not necessarily have to mean the same degree of activity, and the activity may be enhanced. Specifically, for antigen-binding affinity, examples include the case where the value (KD value/parent KD value) obtained by comparison to the binding affinity of the antibody variable region serving as the control (parent KD value) is 1.5 or less. The value of KD value/parent KD value is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, examples include $10^{-1}$, $10^{-2}$, $10^{-3}$, $10^{-4}$, $10^{-5}$, or $10^{-6}$. More specifically, in the present invention, the value of KD value/parent KD value is preferably $10^{-6}$ to $1.5\times10^{-0}$, more preferably $10^{-6}$ to $10^{-1}$, even more preferably $10^{-6}$ to $10^{-2}$, and yet even more preferably $10^{-6}$ to $10^{-3}$. For cytotoxic activity, examples include the case where the value (cell growth inhibition rate/parent cell growth inhibition rate) obtained by comparison to the cell growth inhibition rate of the multispecific antigen-binding molecule serving as the control (parent cell growth inhibition rate) is 0.7 or more. The concentration of the added multispecific antigen-binding molecule can be determined appropriately, but is preferably, for example, 0.01 nM, 0.05 nM, 0.1 nM, 0.5 nM, or 1 nM; and preferably, measurements are taken at 0.05 nM or 0.1 nM. The value for cell growth inhibition rate/parent cell growth inhibition rate is preferably 0.8 or higher, more preferably 0.9 or higher, 1.0 or higher, 1.2 or higher, 1.5 or higher, 2 or higher, 3 or higher, 5 or higher, 10 or higher, or 20 or higher. While there is no upper limit, the value may be 10, $10^2$, $10^3$, $10^4$, $10^5$, or $10^6$.

Furthermore, for cytotoxic activity, examples include the case where the value (concentration for 50% inhibition of cell growth/parent concentration for 50% inhibition of cell growth) obtained by comparison to the concentration of the original multispecific antigen-binding molecule for 50% inhibition of cell growth (parent concentration for 50% inhibition of cell growth) is 1.5 or less. Concentration for 50% growth inhibition refers to the concentration of the multispecific antigen-binding molecule necessary for reducing the cell proliferation rate to one half compared to when the multispecific antigen-binding molecule is not added. The value of "concentration for 50% inhibition of cell growth/parent concentration for 50% inhibition of cell growth" is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, the value may be, for example, $10^{-1}$, $10^{-2}$, $10^{-3}$, $10^{-4}$, $10^{-5}$, or $10^{-6}$. Specifically, the value is preferably $10^{-6}$ to $1.5\times10^{-0}$, more preferably $10^{-6}$ to $10^{-1}$, even more preferably $10^{-6}$ to $10^{-2}$, and yet even more preferably $10^{-6}$ to $10^{-3}$.

Regarding the domain comprising an antibody variable region having GPC3-binding activity, the KD value towards GPC3 (for example, human GPC3) may be, for example, $5\times10^{-9}$ M or less, preferably $4\times10^{-9}$ M or less, such as $3\times10^{-9}$ M or less, $2\times10^{-9}$ M or less, $1\times10^{-9}$ M or less, $8\times10^{-10}$ M or less, $5\times10^{-10}$ M or less, $4\times10^{-10}$ M or less, $3\times10^{-10}$ M or less, $2\times10^{-10}$ M or less, $1\times10^{-10}$ M or less, $8\times10^{-11}$ M or less, $5\times10^{-11}$ M or less, $4\times10^{-11}$ M or less, $3\times10^{-11}$ M or less, $2\times10^{-11}$M or less, $1\times10^{-11}$ M or less, $8\times10^{-12}$ M or less, $5\times10^{-12}$ M or less, $4\times10^{-12}$ M or less, $3\times10^{-12}$ M or less, $2\times10^{-12}$M or less, $1\times10^{-12}$ M or less, $8\times10^{-13}$ M or less, $5\times10^{-13}$ M or less, $4\times10^{-13}$ M or less, $3\times10^{-13}$ M or less, $2\times10^{-13}$ M or less, or $1\times10^{-13}$ M or less.

Regarding the domain comprising an antibody variable region having T-cell receptor complex-binding activity, the KD value towards a human T-cell receptor complex such as a human T cell receptor, or more specifically for example human CD3ε may be, for example, $2\times10^{-7}$ M or less, preferably $1.5\times10^{-7}$ M or less, such as $1.4\times10^{-7}$ M or less, $1.3\times10^{-7}$ M or less, $1.2\times10^{-7}$M or less, $1\times10^{-7}$ M or less, $3\times10^{-8}$ M or less, $2\times10^{-8}$ M or less, $1\times10^{-8}$M or less, $8\times10^{-9}$M or less, $5\times10^{-9}$ M or less, $4\times10^{-9}$ M or less, $3\times10^{-9}$ M or less, $2\times10^{-9}$M or less, $1\times10^{-9}$M or less, $8\times10^{-10}$ M or less, $5\times10^{-10}$ M or less, $4\times10^{-10}$ M or less, $3\times10^{-10}$ M or less, $2\times10^{-10}$ M or less, $1\times10^{-10}$ M or less, $8\times10^{-11}$M or less, $5\times10^{-11}$ M or less, $4\times10^{-11}$ M or less, $3\times10^{-11}$ M or less, $2\times10^{-11}$ M or less, $1\times10^{-11}$ M or less, $8\times10^{-12}$ M or less, $5\times10^{-12}$M or less, $4\times10^{-12}$ M or less, $3\times10^{-12}$ M or less, $2\times10^{-12}$ M or less, or $1\times10^{-12}$ M or less.

The multispecific antigen-binding molecules of the present invention preferably have KD values toward human GPC3 and human T-cell receptor complex (for example, human CD3ε chain) that are $5\times10^{-9}$ M or less and $2\times10^{-7}$M or less, respectively, and more preferably $1\times10^{-9}$ M or less and $5\times10^{-8}$ M or less, respectively.

In the present invention, antibody variable regions that are "functionally equivalent" are not particularly limited as long as they are antibody H-chain and/or antibody L-chain variable regions that satisfy the above-described conditions. Examples of such antibody variable regions include regions produced by introducing substitution, deletion, addition, and/or insertion of one or more amino acids (for example, 1, 2, 3, 4, 5, or 10 amino acids) into the amino acid sequences of the variable regions of Tables 1 to 3 mentioned above. A method well known to those skilled in the art for introducing one or more amino-acid substitutions, deletions, additions, and/or insertions into an amino acid sequence is a method of introducing mutations into proteins. For example, those skilled in the art can prepare variable regions that are functionally equivalent to the antibody variable regions having the above-mentioned functions by appropriately introducing mutations into amino acid sequences using methods such as site-directed mutagenesis (Hashimoto-Gotoh, T., Mizuno, T., Ogasahara, Y., and Nakagawa, M. (1995) An oligodeoxyribonucleotide-directed dual amber method for site-directed mutagenesis. Gene 152, 271-275; Zoller, M. J., and Smith, M. (1983) Oligonucleotide-directed mutagenesis of DNA fragments cloned into M13 vectors. Methods Enzymol. 100, 468-500; Kramer, W., Drutsa, V., Jansen, H. W., Kramer, B., Pflugfelder, M., and Fritz, H. J. (1984) The gapped duplex DNA approach to oligonucleotide-directed mutation construction. Nucleic Acids Res. 12, 9441-9456; Kramer, W., and Fritz, H. J. (1987) Oligonucleotide-directed construction of mutations via gapped duplex DNA Methods. Enzymol. 154, 350-367; and Kunkel, T. A. (1985) Rapid and efficient site-specific mutagenesis without phenotypic selection. Proc Natl Acad. Sci. USA. 82, 488-492).

When an amino acid residue is altered, the amino acid is preferably mutated into a different amino acid(s) that conserves the properties of the amino acid side-chain. Examples of amino-acid side chain properties are: hydrophobic amino acids (A, I, L, M, F, P, W, Y, and V), hydrophilic amino acids (R, D, N, C, E, Q, G, H, K, S, and T), amino acids containing aliphatic side chains (G, A, V, L, I, and P), amino acids containing hydroxyl group-containing side chains (S, T, and Y), amino acids containing sulfur atom-containing side chains (C and M), amino acids containing carboxylic acid- and amide-containing side chains (D, N, E, and Q), amino acids containing basic side chains (R, K, and H), and amino acids containing aromatic side chains (H, F, Y, and W) (amino acids are represented by one-letter codes in parentheses). Amino acid substitutions within each of these groups are called conservative substitutions. It is already known that a polypeptide containing a modified amino acid sequence in which one or more amino acid residues in a given amino acid sequence are deleted, added, and/or substituted with other amino acids can retain the original biological activity (Mark, D. F. et al., Proc. Natl. Acad. Sci. USA; (1984) 81: 5662-6; Zoller, M. J. and Smith, M., Nucleic Acids Res. (1982) 10: 6487-500; Wang, A. et al., Science (1984) 224: 1431-3; Dalbadie-McFarland, G. et al., Proc. Natl. Acad. Sci. USA (1982) 79: 6409-13). Variable regions of the present invention containing such amino acid modifications have an amino acid sequence identity of at least 70%, more preferably at least 75%, even more preferably at least 80%, still more preferably at least 85%, yet more preferably at least 90%, and most preferably at least 95%, with the amino acid sequence of the CDR sequences, FR sequences, or whole variable regions of the variable region prior to modification. Herein, sequence identity is defined as the percentage of residues identical to those in the original amino acid sequence of the H-chain variable region or L-chain variable region determined after the sequences are aligned, and gaps are appropriately introduced to maximize the sequence identity as necessary. The identity of amino acid sequences can be determined by the method described below.

Furthermore, a "functionally equivalent antibody variable region" can be obtained, for example, from nucleic acids that hybridize under stringent conditions with nucleic acids comprising a nucleotide sequence encoding the amino acid sequence of a variable region in Tables 1 to 3 mentioned above. Stringent hybridization conditions for isolating a nucleic acid that hybridizes under stringent conditions with a nucleic acid comprising a nucleotide sequence encoding the amino acid sequence of a variable region include, for example, the conditions of 6 M urea, 0.4% SDS, 0.5×SSC, and 37° C., or hybridization conditions with a stringency equivalent thereto. Isolation of nucleic acids with a much higher homology can be expected with more stringent conditions, for example, the conditions of 6 M urea, 0.4% SDS, 0.1×SSC, and 42° C. The washing conditions following the hybridization are, for example, washing using 0.5× SSC (1×SSC is 0.15 M NaCl and 0.015 M sodium citrate at pH7.0) and 0.1% SDS at 60° C., more preferably washing using 0.2×SSC and 0.1% SDS at 60° C., even more preferably washing using 0.2×SSC and 0.1% SDS at 62° C., yet even more preferably washing using 0.2×SSC and 0.1% SDS at 65° C., and still more preferably washing using 0.1×SSC and 0.1% SDS at 65° C. The sequences of the isolated nucleic acids can be determined by the known methods described below. The overall nucleotide sequence homology of the isolated nucleic acid is at least 50% or higher, preferably 70% or higher, and more preferably 90% or higher (for example, 95%, 96%, 97%, 98%, 99%, or higher) sequence identity.

Nucleic acids that hybridize under stringent conditions to a nucleic acid comprising a nucleotide sequence encoding the amino acid sequence of a variable region can also be isolated by using, instead of the above-described methods using hybridization techniques, gene amplification methods such as polymerase chain reaction (PCR) that uses primers synthesized based on information of the nucleotide sequence encoding the variable-region amino acid sequence.

The identity of one nucleotide sequence or amino acid sequence to another can be determined using the algorithm BLAST, by Karlin and Altschul (Proc. Natl. Acad. Sci. USA (1993) 90: 5873-7). Programs called BLASTN and BLASTX were developed based on this algorithm (Altschul et al., J. Mol. Biol. (1990) 215: 403-10). To analyze nucleotide sequences according to BLASTN based on BLAST, the parameters are set, for example, as score =100and wordlength =12. On the other hand, parameters used for the analysis of amino acid sequences by BLASTX based on BLAST include, for example, score =50 and wordlength =3. Default parameters for each program are used when using the BLAST and Gapped BLAST programs. Specific techniques for such analyses are known in the art (see the website of the National Center for Biotechnology Information (NCBI), Basic Local Alignment Search Tool (BLAST); www.ncbi.nlm.nih.gov).

The combination of the antibody variable region having glypican 3-binding activity and the antibody variable region having T-cell receptor complex binding activity as comprised in the multispecific antigen-binding molecule of the present invention is not particularly limited as long as it has the above-described activities. However, in the present invention, the cytotoxic activity of the multispecific antigen-binding molecule is preferably equivalent to or greater than that of the bispecific antibody GPC3_ERY22_rCE115 described in Example 3. Here, the term "equivalent" does not necessarily have to mean the same degree of activity as described above, and the activity may be enhanced. Being equivalent to GPC3_ERY22_rCE115 is, for example, when the value of (cell growth inhibition rate/cell growth inhibition rate (GPC3_ERY22_rCE115)) relative to the cell growth inhibition rate of GPC3_ERY22_rCE115 (cell growth inhibition rate (GPC3_ERY22_rCE115)) is 0.7 or greater, preferably 0.8 or greater, 0.9 or greater, 1.0 or greater, 1.2 or greater, 1.5 or greater, 2 or greater, 3 or greater, 5 or greater, 10 or greater, or 20 or greater. While there is no upper limit, the value may be, for example, 10, $10^2$, $10^3$, $10^4$, $10^5$, or $10^6$. The concentration of the multispecific antigen-binding molecule to be added can be determined appropriately, but is preferably, for example, 0.01 nM, 0.05 nM, 0.1 nM, 0.5 nM, or 1 nM; and preferably, measurements are taken at 0.05 nM or 0.1 nM.

Furthermore, examples include the case where the value (concentration for 50% inhibition of cell growth/concentration for 50% inhibition of cell growth (GPC3_ERY22_rCE115)) obtained by comparison to the concentration for 50% inhibition of growth of GPC3_ERY22_rCE115 cells (concentration for 50% inhibition of cell growth (GPC3_ERY22_rCE115)) is 1.5 or less. The value for "concentration for 50% inhibition of cell growth/concentration for 50% inhibition of cell growth (GPC3_ERY22_rCE115)" is preferably 1.3 or less, more preferably 1.2 or less, 1.1 or less, 1.0 or less, 0.9 or less, 0.8 or less, 0.7 or less, 0.6 or less, or 0.5 or less. While there is no lower limit, the value may be for example, $10^{-1}$, $10^{-2}$, $10^{-3}$, $10^{-4}$, $10^{-5}$, or $10^{-6}$. Specifically, the value is preferably $10^{-6}$ to $1.5 \times 10^{-0}$, more preferably $10^{-6}$ to $10^{-1}$, even more preferably $10^{-6}$ to $10^{-2}$, and yet even more preferably $10^{-6}$ to $10^{-3}$.

The preferred specific KD values for human GPC3 and human T cell receptor complex (for example, human CD3ε chain) are also as indicated above. Desired cells showing GPC3 expression or desired tissues containing these cells may be used for the cells, and for example, PC-10 or NCI-H446 which are GPC3-expressing human cancer cell lines can be used.

Examples of such a combination of the antibody variable region having glypican 3-binding activity and the antibody variable region having T-cell receptor complex binding activity, include the combinations of antibody H-chain variable regions shown in Table 4, combinations of antibody H-chain variable regions having CDR sequences whose CDR1, CDR2, and CDR3 amino acid sequences are the same as the CDR1, CDR2, and CDR3 amino acid sequences carried by the antibody H-chain variable regions of Table 4, and combinations of antibody H-chain variable regions functionally equivalent to these variable regions. Here, "functionally equivalent" has the same meaning described above.

TABLE 4

| GPC3 side/T cell receptor complex side | SEQ ID NO: |
|---|---|
| H0000/hCE115HA | 40/52 |
| H0000/CE115HA251 | 40/500 |
| H0000/CE115HA236 | 40/429 |
| H0000/TR01H002 | 40/421 |
| H0000/CE115HA122 | 40/426 |
| H0610/rCE115H | 215/424 |
| H0610/TR01H040 | 215/103 |
| H0610/TR01H061 | 215/122 |
| H0610/TR01H068 | 215/129 |
| H0610/TR01H071 | 215/132 |
| GCH054/TR01H067 | 197/128 |
| GCH094/TR01H082 | 211/142 |
| GCH094/TR01H084 | 211/144 |
| GCH065/TR01H084 | 206/144 |
| GCH065/TR01H082 | 206/142 |
| GCH094/TR01H109 | 211/164 |
| GCH065/TR01H109 | 206/164 |
| GCH094/TR01H113 | 211/168 |
| GCH065/TR01H113 | 206/168 |

A preferred common L chain for such combinations of an antibody variable region having glypican 3-binding activity and an antibody variable region having T-cell receptor complex binding activity includes, for example, L0000, L0011, L0201, L0203, L0204, L0206, L0208, L0209, L0211, L0212, L0222, and a common L chain having CDR sequences (CDR1, CDR2, and CDR3 amino acid sequences) identical to the CDR1, CDR2, and CDR3 amino acid sequences as in the above common L chain. Specific combinations include, for example, the combinations of antibody H-chain variable regions and a common L chain shown in Table 5, combinations of antibody variable regions having CDR sequences (CDR1, CDR2, and CDR3 amino acid sequences) identical to the amino acid sequences of CDR1, CDR2, and CDR3 carried by the antibody variable regions and a common L chain of Table 5, and combinations of antibody H-chain variable regions and a common L chain functionally equivalent to these variable regions. Here, "functionally equivalent" has the same meaning as described above.

TABLE 5

| GPC3 side/T cell receptor complex side/common L chain | SEQ ID NO: |
|---|---|
| H0610/rCE115H/L0000 | 215/424/53 |
| H0610/TR01H040/L0000 | 215/103/53 |
| H0610/TR01H040/L0201 | 215/103/299 |
| H0610/TR01H040/L0203 | 215/103/301 |
| H0610/TR01H040/L0204 | 215/103/302 |
| H0610/TR01H040/L0206 | 215/103/304 |
| H0610/TR01H040/L0208 | 215/103/306 |
| H0610/TR01H040/L0209 | 215/103/307 |
| H0610/TR01H040/L0211 | 215/103/309 |
| H0610/TR01H061/L0000 | 215/122/53 |
| H0610/TR01H068/L0000 | 215/129/53 |
| H0610/TR01H071/L0000 | 215/132/53 |
| GCH054/TR01H067/L0201 | 197/128/299 |
| GCH054/TR01H067/L0212 | 197/128/310 |
| GCH054/TR01H067/L0222 | 197/128/319 |
| GCH054/TR01H067/L0000 | 197/128/53 |
| GCH094/TR01H082/L0201 | 211/142/299 |
| GCH094/TR01H082/L0011 | 211/142/223 |
| GCH094/TR01H084/L0011 | 211/144/223 |
| GCH065/TR01H084/L0011 | 206/144/223 |
| GCH065/TR01H082/L0011 | 206/142/223 |
| GCH094/TR01H109/L0011 | 211/164/223 |
| GCH065/TR01H109/L0011 | 206/164/223 |
| GCH094/TR01H113/L0011 | 211/168/223 |
| GCH065/TR01H113/L0011 | 206/168/223 |

The Fc region comprised in the multispecific antigen-binding molecule of the present invention is not particularly limited as long as it is an Fc region having reduced Fcγ receptor-binding activity, but examples of a preferred Fc region of the present invention include a combination of the Fc-region portion of E22Hh and the Fc-region portion of E22Hk, a combination of the Fc-region portion of E2702GsKsc and the Fc-region portion of E2704sEpsc, and a combination of the Fc-region portion of E2702sKsc and the Fc-region portion of E2704sEpsc.

Examples of a preferred multispecific antigen-binding molecule of the present invention include bispecific antibodies comprising an antibody variable region having glypican 3-binding activity and an antibody variable region having CD3ε-binding activity. More preferably, the cytotoxic activity is the same or greater than that of the GPC3_ERY22_rCE115 bispecific antibody. Examples of such bispecific antibodies include bispecific antibodies comprising H and L chains described in Table 13, and bispecific antibodies that bind to an epitope overlapping with an epitope bound by the above antibodies, and which contain an Fc region with reduced Fcγ receptor-binding activity.

Whether an antibody recognizes an epitope that overlaps with an epitope recognized by another antibody can be confirmed by the competition between the two antibodies against the epitope. Competition between the antibodies can be evaluated by competitive binding assays using means such as enzyme-linked immunosorbent assay (ELISA), fluorescence energy transfer method (FRET), and fluorometric microvolume assay technology (FMAT (Registered trademark)). The amount of an antibody bound to an antigen indirectly correlates with the binding ability of a candidate competitor antibody (a test antibody) that competitively binds to the overlapping epitope. In other words, as the amount or affinity of a test antibody against the overlapping epitope increases, the amount of the antibody bound to the antigen decreases, and the amount of the antigen-bound test antibody increases. Specifically, the appropriately labeled antibody and antibody to be evaluated are simultaneously added to the antigen, and the antibody bound as a result are detected using the label. The amount of the antigen-bound antibody can be easily determined by labeling the antibody beforehand. This label is not particularly limited, and the labeling method is selected according to the assay technique used. Specifically, the labeling method includes fluorescent labeling, radiolabeling, enzymatic labeling, and such.

For example, the fluorescently labeled antibody and the unlabeled antibody or test antibody are simultaneously added to beads immobilized with GPC3 or CD3ε, and the labeled antibody is detected by fluorometric microvolume assay technology.

Herein, the "antibody that binds to the overlapping epitope" refers to a test antibody that can reduce the amount of the bound labeled antibody by at least 50% at a concentration that is usually 100 times higher, preferably 80 times higher, more preferably 50 times higher, even more preferably 30 times higher, and still more preferably 10 times higher than the concentration at which the non-labeled antibody reduces 50% of the amount of the labeled antibody bound ($IC_{50}$).

Multispecific antigen-binding molecules, which have the antigen-binding sites of antibodies that bind to epitopes overlapping with epitopes bound by the above-mentioned antibodies, can yield excellent cytotoxic activity.

The multispecific antigen-binding molecules of the present invention are produced by the same technique as the method for producing recombinant antibodies mentioned above.

The present invention also relates to polynucleotides encoding the antigen-binding molecules of the present invention, and they can be inserted into discretionary expression vectors. Suitable hosts can be transformed with the expression vectors to produce cells that express the antigen-binding molecules. Antigen-binding molecules encoded by the polynucleotides can be obtained by culturing the cells that express the antigen-binding molecules, and collecting the expression products from culture supernatants. That is, the present invention relates to vectors comprising a polynucleotide encoding an antigen-binding molecule of the present invention, cells carrying such a vector, and methods for producing antigen-binding molecules, which comprise culturing the cells and collecting antigen-binding molecules from culture supernatants. These can be obtained by techniques similar to those for recombinant antibodies mentioned above.

Pharmaceutical Compositions

From another viewpoint, the present invention provides pharmaceutical compositions comprising as the active ingredient a multispecific antigen-binding molecule that comprises: (1) a domain comprising an antibody variable region having glypican 3-binding activity, (2) a domain comprising an antibody variable region having T-cell receptor complex-binding activity, and (3) a domain comprising an Fc region with reduced binding activity towards an Fcγ receptor. Furthermore, the present invention relates to pharmaceutical compositions that induce cell injury, which comprise the antigen-binding molecule as an active ingredient. Pharmaceutical compositions of the present invention which induce the described cell injury, particularly T-cell-dependent cellular cytotoxicity, are preferably administered to a subject suffering from a disease for which the activities are needed for prevention or treatment, or a subject in which the disease is possible to relapse.

Furthermore, in the present invention, cytotoxicity-inducing agents and cell growth-inhibiting agents comprising as the active ingredient a multispecific antigen-binding molecule that comprises:

(1) a domain comprising an antibody variable region having glypican 3-binding activity,
(2) a domain comprising an antibody variable region having T-cell receptor complex-binding activity, and
(3) a domain comprising an Fc region with reduced binding activity towards an Fcγ receptor can be presented as a method for inducing cell injury which comprises the step of administering the antigen-binding molecule to a subject, or it can be presented as use of the antigen-binding molecule in the manufacture of a cytotoxicity-inducing agent and a cell growth-inhibiting agent.

In the present invention "comprising as the active ingredient a multispecific antigen-binding molecule that comprises (1) a domain comprising an antibody variable region having glypican 3-binding activity, (2) a domain comprising an antibody variable region having T-cell receptor complex-binding activity, and (3) a domain comprising an Fc region with reduced binding activity towards an Fcγ receptor" means comprising the antigen-binding molecule as a major active component, without limitation to the content ratio of the antigen-binding molecule.

If necessary, multispecific antigen-binding molecules of the present invention may be encapsulated in microcapsules (e.g., those made of hydroxymethylcellulose, gelatin, and poly(methylmetacrylate)), or incorporated as components of a colloidal drug delivery system (e.g., liposomes, albumin microspheres, microemulsion, nanoparticles, and nanocapsules) (see, for example, "Remington's Pharmaceutical Science 16th edition", Oslo Ed. (1980)). Methods for preparing the pharmaceutical agents as controlled-release pharmaceutical agents are also well known, and such methods may be applied to the multispecific antigen-binding molecules of the present invention (J. Biomed. Mater. Res. (1981) 15: 267-277; Chemtech. (1982) 12: 98-105; U.S. Pat. No. 3,773,719; European Patent Application Publication Nos. EP 58,481 and EP 133,988; Biopolymers (1983) 22: 547-556).

The pharmaceutical compositions of the present invention or cytotoxicity-inducing agents and cell growth-inhibiting agents may be administered to patients by oral or parenteral administration, and parenteral administration is preferred. Specific examples of the administration method include administration by injection, transnasal administration, transpulmonary administration, and transdermal administration. Examples of administration by injection include intravenous injection, intramuscular injection, intraperitoneal injection, and subcutaneous injection. A pharmaceutical composition of the present invention or a cytotoxicity-inducing agent and a cell growth-inhibiting agent can be administered systemically or locally, for example, through administration by injection. The method of administration can be selected appropriately according to the age and symptoms of the patient. The dose can be selected from the range of 0.0001 mg to 1000 mg per kilogram body weight for a single administration. Alternatively, for example, the dose may be selected from the range of 0.001 mg/body to 100000 mg/body per patient. However, the pharmaceutical compositions of the present invention or a cytotoxicity-inducing agent and cell growth-inhibiting agent are not limited to these doses.

The pharmaceutical compositions of the present invention or cytotoxicity-inducing agents and cell growth-inhibiting agents can be formulated according to conventional methods (for example, Remington's Pharmaceutical Science, latest edition, Mark Publishing Company, Easton, U.S.A), and may also contain pharmaceutically acceptable carriers and additives. Examples include, but are not limited to surfactants, excipients, coloring agents, perfumes, preservatives, stabilizers, buffers, suspending agents, isotonization agents, binders, disintegrants, lubricants, fluidity promoting agents, and flavoring agents; and other commonly used carriers can be suitably used. Specific examples of the carriers include light anhydrous silicic acid, lactose, crystalline cellulose, mannitol, starch, carmellose calcium, carmellose sodium, hydroxypropyl cellulose, hydroxypropyl methyl cellulose, polyvinylacetal diethylaminoacetate, polyvinylpyrrolidone, gelatin, medium chain fatty acid triglyceride, polyoxyethylene hardened castor oil 60, saccharose, carboxymethyl cellulose, corn starch, inorganic salt, and such.

The present invention also provides methods for damaging glypican 3 antigen-expressing cells or tumor tissues containing the antigen-expressing cells, or methods for suppressing growth of these cells or tumor tissues by contacting the glypican 3 antigen-expressing cells with a multispecific antigen-binding molecule of the present invention that binds to the antigen. The multispecific antigen-binding molecule that binds to the antigen is as described above for an antigen-binding molecule of the present invention that binds to the antigen, which is comprised in the cytotoxicity-inducing agents and cell growth-inhibiting agents of the present invention. The cells bound by a multispecific antigen-binding molecule of the present invention that binds to the antigen are not particularly limited as long as they are cells expressing the antigen.

In the present invention, "contact" is carried out, for example, by adding a multispecific antigen-binding molecule of the present invention which binds to the antigen to the culture medium of GPC3 antigen-expressing cells cultured in vitro. In this case, a liquid or a solid obtained by freeze-drying or such may be suitably used as the form of the added antigen-binding molecule. When added as an aqueous solution, it may be an aqueous solution that simply contains only the multispecific antigen-binding molecule of the present invention, or it may be a solution containing also, for example, the above-mentioned surfactants, excipients, coloring agents, perfumes, preservatives, stabilizers, buffers, suspending agents, isotonization agents, binders, disintegrants, lubricants, fluidity promoting agents, and flavoring agents. The concentration at which the addition is performed is not particularly limited, but a suitable final concentration in the culture solution is preferably in the range of 1 pg/ml to 1 g/ml, more preferably 1 ng/ml to 1 mg/ml, and even more preferably 1 µg/mL to 1 mg/mL.

Furthermore, in another embodiment, "contact" of the present invention is also carried out by administering an antigen-binding molecule of the present invention to non-human animals with cells expressing the GPC3 antigen transplanted into their bodies, and to animals carrying cells that intrinsically express the antigen. The method of administration may be oral or parenteral, and parenteral administration is particularly preferred. Specific examples of the administration method include administration by injection, transnasal administration, transpulmonary administration, and transdermal administration. Examples of administration by injection include intravenous injection, intramuscular injection, intraperitoneal injection, and subcutaneous injection. A pharmaceutical composition of the present invention or a cytotoxicity-inducing agent and a cell growth-inhibiting agent can be administered systemically or locally, for example, through administration by injection. The method of administration can be selected appropriately according to the age and symptoms of the test animal. When administered as an aqueous solution, an aqueous solution containing simply only a multispecific antigen-binding molecule of the present invention may be used, or a solution containing also the above-mentioned surfactants, excipients, coloring agents, perfumes, preservatives, stabilizers, buffers, suspending agents, isotonization agents, binders, disintegrants, lubricants, fluidity promoting agents, flavoring agents, and such may be used. The dose can be selected from the range of 0.0001 mg to 1000 mg per kilogram body weight for a single administration.

Alternatively, for example, the dose may be selected from the range of 0.001 mg/body to 100000 mg/body per patient. However, the amount of the multispecific antigen-binding molecule of the present invention administered is not limited to these doses.

The following method is suitably used as a method for evaluating or measuring cell injury induced in cells expressing the glypican 3 antigen which is bound by a domain carrying an antibody variable region having glypican 3-binding activity that constitutes the antigen-binding molecule as a result of contacting the cells with a multispecific antigen-binding molecule of the present invention. Examples of a method for evaluating or measuring the cytotoxic activity in vitro include methods for measuring cytotoxic T cell activity and such. Whether or not a multispecific antigen-binding molecule of the present invention has T cellular cytotoxicity can be measured by known methods (for example, Current protocols in Immunology, Chapter 7. Immunologic studies in humans, Editor, John E. Coligan et al., John Wiley & Sons, Inc., (1993) and the like). For activity measurements, an antigen-binding molecule that binds to an antigen different from glypican 3, which is an antigen not expressed in the cells used for the examination, can be used as a control in the same manner as a multispecific antigen-binding molecule of the present invention, and the activity can be determined to be present when the multispecific antigen-binding molecule of the present invention shows a stronger cytotoxic activity than when the antigen-binding molecule is used as a control.

To evaluate or measure cytotoxic activity in vivo, for example, cells expressing a glypican 3 antigen are intradermally or subcutaneously transplanted to a non-human test animal, and then a test antigen-binding molecule is intravenously or intraperitoneally administered daily or with an interval of few days, starting from the day of transplantation or the following day. Cytotoxic activity can be determined by daily measurement of tumor size and by observing difference in the change of tumor size. In a similar manner to the in vitro evaluation, the cytotoxic activity of an antigen-binding molecule of the present invention can be determined to be present when administration of a control antigen-binding molecule shows that the tumor size in the group subjected to administration of an antigen-binding molecule of the present invention is significantly smaller than the tumor size in the group subjected to administration of the control antigen-binding molecule.

As a method for evaluating or measuring the suppressive effect on proliferation of cells expressing a glypican 3 antigen, a method of measuring the uptake of isotope-labeled thymidine into cells or the MTT method may be suitably used. As a method for evaluating or measuring the cell proliferation-suppressing activity in vivo, the same method described above for evaluating or measuring cytotoxic activity in vivo may be suitably used.

The present invention also provides kits for use in the methods of the present invention, which comprise a multispecific antigen-binding molecule of the present invention or a multispecific antigen-binding molecule produced by a production method of the present invention. Additionally, the kit may include in its package, a pharmaceutically acceptable carrier, solvent, and instructions describing the method of use.

The present invention also relates to a multispecific antigen-binding molecule of the present invention or a multispecific antigen-binding molecule produced by a production method of the present invention for use in a method of the present invention.

The present invention also relates to molecules having GPC3-binding activity, which contain a domain comprising an antibody variable region having GPC3-binding activity of the multispecific antigen-binding molecule of the present invention. Furthermore, the present invention relates to a molecule having GPC3-binding activity, which comprises the antibody variable regions of H and L chains respectively comprising the three CDRs of the H and L chains (total of six CDRs) contained in the molecule. The present invention also relates to molecules having T-cell receptor complex-binding activity, which contain a domain comprising an antibody variable region having T-cell receptor complex-binding activity of the multispecific antigen-binding molecule of the present invention. Furthermore, the present invention relates to a molecule having T-cell receptor complex-binding activity that comprises the antibody variable regions of the H and L chains respectively comprising the three CDRs of the H and L chains (total of six CDRs) contained in the molecule. Such molecules may be antibodies or polypeptides comprising antigen-binding fragments of an antibody. The present invention also relates to antibodies that bind to epitopes overlapping or competing with these molecules or polypeptides containing the antigen-binding fragments thereof. Suitable examples of such polypeptides comprising antigen-binding fragments of an antibody include scFv, single chain antibody, Fv, single chain Fv 2 (scFv2), Fab, and F(ab')$_2$. Furthermore, these molecules do not have to be multispecific (bispecific), and may bind only to either GPC3 or a T cell receptor complex (for example, the CD3ε chain).

These molecules include a molecule comprising a domain that comprises an antibody variable region having GPC-binding activity of the multispecific antigen-binding molecule exemplified in detail in the Examples herein (which comprises the H-chain variable regions having GPC3-binding activity and the common L-chain variable region), a molecule comprising a domain that comprises an antibody variable region having T cell receptor complex-binding activity of the multispecific antigen-binding molecule exemplified in the Examples herein (which comprises the H-chain variable regions having T cell receptor complex-binding activity and the common L-chain variable region), and also a molecule having an activity to bind to the same antigenic protein (GPC3 or T-cell receptor complex), which comprises the three CDRs of each of the H and L chains (total of six CDRs) contained in the above molecule.

These molecules have CDRs that are in common with those of a multispecific antigen-binding molecule of the present invention; and therefore, they are expected to bind to an epitope overlapping with an epitope for the multispecific antigen-binding molecule of the present invention. Therefore, these molecules can compete with multispecific antigen-binding molecules of the present invention when they coexist with the multispecific antigen-binding molecules of the present invention. Accordingly, these molecules can be used, for example, as regulatory agents for suppressing activities (such as antigen-binding activity, cytotoxic activity, and antitumor activity) of the multispecific antigen-binding molecules of the present invention. Furthermore, such a molecule can be bound to a target protein (GPC3 or T cell receptor complex) in advance, and when a multispecific antigen-binding molecule of the present invention is added, the molecules that dissociate through competition can be detected. This way, the molecule is useful as an agent for detecting binding of a multispecific antigen-binding molecule of the present invention to a target protein. Here, such molecules may be labeled appropriately with fluorescent substances or such. Alternatively, these molecules are useful for screening novel antibodies that bind to epitopes overlapping with the epitopes bound by the multispecific antigen-binding molecules of the present invention. As described above, such a molecule can be bound to a target protein (GPC3 or T cell receptor complex) in advance, and when a test antibody is added, if the bound molecules dissociate, then the test antibody is a candidate for an antibody that binds to an epitope overlapping with the epitope bound by the multispecific antigen-binding molecule of the present invention. This will enable efficient screening of novel multispecific antigen-binding molecules.

The combinations presented as examples herein as combinations of each CDR of the multispecific antigen-binding molecules of the present invention can be directly used as specific combinations of CDRs of the H-chain and L-chain variable regions in these molecules. The antigen affinity of these molecules (KD values) is preferably a value exemplified herein as the KD value of a multispecific antigen-binding molecule of the present invention, but is not limited thereto.

The present invention also relates to nucleic acids encoding these molecules, vectors comprising the nucleic acids, cells comprising the nucleic acids or the vectors, methods for producing the molecules by culturing the cells, and molecules produced by these methods.

All prior art references cited herein are incorporated by reference into this description.

EXAMPLES

Herein below, the present invention will be specifically described with reference to the Examples, but it is not to be construed as being limited thereto.

Example 1

Production of GPC3_ERY22_rCE115 and Measurement of Cytotoxic Activity (1-1) Production of GPC3_ERY22_rCE115

A molecule in which one of the Fabs has been replaced with a CD3 epsilon-binding domain was produced using IgG against a cancer antigen (GPC3) as the basic structure. In this case, the IgG Fc used as the basic structure was a silent Fc with attenuated affinity for FcgR (an Fcγ (Fc gamma) receptor). An anti-GPC3 antibody, H0000 (SEQ ID NO:40)/GL4 (SEQ ID NO:41), was used as the GPC3-binding domain. An anti-CD3 antibody, rCE115H/rCE115L (SEQ ID NO:42/SEQ ID NO:43), was used as the CD3-binding domain.

G1d produced by removing Gly and Lys at the C terminus of IgG1 was used as the antibody H-chain constant region, and this was used in combination with H0000/GL4 and rCE115H/rCE115L. When the antibody H-chain constant region was named H1, the sequence corresponding to the H chain of the antibody carrying H0000 in the variable region was shown as H0000-H1. Here, an amino acid alteration was shown, for example, as D356K. The first alphabet (corresponding to D in D356K) is the one-letter code representation for the amino acid residue before modification, the number that follows (corresponding to 356 of D356K) is the position of modification indicated by EU numbering, and the final alphabet (corresponding to K of D356K) is the one-letter code representation for the amino acid residue after modification. G1dh (SEQ ID NO:44) produced by removing Gly and Lys at the C terminus of IgG1, ERY22_Hk (SEQ ID NO:45) produced by introducing the L234A/L235A/Y349C/T366W mutations into G1dh, and ERY22_Hh (SEQ ID NO:46) produced by introducing the L234A/L235A/D356C/T366S/L368A/Y407V mutations into G1dh were prepared according to the method of Reference Example 1. The L234A and L235A mutations were introduced into the respective H chains to attenuate affinity for FcgR (an Fcγ receptor), and the Y349C/T366W and D356C/T366S/L368A/Y407V mutations were introduced to efficiently form heteromers of each H chain when producing heterodimeric antibodies comprising two types of H chains.

The heterodimeric antibody, GPC3_ERY22_rCE115, produced by substitution with the VH and VL domains of Fab against GPC3 was prepared according to Reference Example 1(FIG. 1A).

A series of expression vectors inserted with a polynucleotide encoding each of GL4-ERY22_Hk (SEQ ID NO:47), H0000-ERY22_L (SEQ ID NO:48), rCE115H-ERY22_Hh (SEQ ID NO:49), and rCE115L-k0 (SEQ ID NO:50) were produced by methods well-known to those skilled in the art, such as PCR methods using primers added with an appropriate sequence similar to those in the above-described method.

The following combination of expression vectors were introduced into FreeStyle 293-F cells for transient expression of each target molecule.
Target molecule: GPC3_ERY22_rCE115
Polypeptides encoded by the polynucleotides inserted into the expression vectors: GL4-ERY22_Hk, H0000-ERY22_L, rCE115H-ERY22_Hh, rCE115L-k0

(1-2) Purification of GPC3_ERY22_rCE115

The obtained culture supernatant was added to an anti-FLAG M2 column (Sigma), and then the column was washed, followed by elution using 0.1 mg/mL of a FLAG peptide (Sigma). The fractions containing the molecule of interest were added to a HisTrap HP column (GE Healthcare), and then the column was washed, followed by elution using an imidazole concentration gradient. Fractions containing the molecule of interest were concentrated using an ultrafiltration membrane, then the fractions were added to a Superdex 200 column (GE Healthcare), and each of the purified molecules of interest was obtained by collecting only the monomeric fractions from the eluted solution.

(1-3) Measurement of the Cytotoxic Activity of GPC3_ERY22_rCE115 Using Human Peripheral Blood Mononuclear Cells The in vitro cytotoxic activity of GPC3_ERY22_rCE115 was assessed.

(1-3-1) Preparation of a Human Peripheral Blood Mononuclear Cell (PBMC) Solution Using a syringe preloaded with 100 μL of 1,000 units/mL heparin solution (Novo Heparin for injection, 5000 units, Novo Nordisk), 50 mL of peripheral blood was collected from each healthy volunteer (adult individual). This peripheral blood was diluted two-fold in PBS(−), divided into four aliquots, and added into a Leucosep tube for lymphocyte separation (Cat. No. 227290, Greiner Bio-One) that had been loaded with 15 mL of Ficoll-Paque PLUS and subjected to centrifugation in advance. This separation tube was centrifuged (at 2150 rpm for ten minutes at room temperature), and then the mononuclear cell fraction was collected. The cells in the mononuclear cell fraction were washed once with the Dulbecco's Modified Eagle's Medium containing 10% FBS (manufactured by SIGMA, hereinafter referred to as 10% FBS/D-MEM), and then prepared to have a cell density of $4 \times 10^6$ cells/mL using 10% FBS/D-MEM. The cell suspension prepared this way was used as the human PBMC solution in the experiment below.

(1-3-2) Measurement of Cytotoxic Activity

Cytotoxic activity was assessed by the rate of cell growth inhibition using the xCELLigence Real-Time Cell Analyzer (Roche Diagnostics). The NCI-H446 human cancer cell line or the PC-10 human cancer cell line, which expresses human GPC3, was used as the target cell. NCI-H446 or PC-10 was detached from the dish, then the cells were plated into E-Plate 96 (Roche Diagnostics) in aliquots of 100 μL/well by adjusting the cells to $1 \times 10^4$ cells/well, and measurement of live cells was begun using the xCELLigence Real-Time Cell Analyzer. On the following day, the plate was removed from the xCELLigence Real-Time Cell Analyzer, and 50 μL of the respective antibodies prepared at each concentration (0.004, 0.04, 0.4, 4, or 40 nM) were added to the plate. After 15 minutes of reaction at room temperature, 50 μL of the human PBMC solution prepared in (1-2) was added ($2 \times 10^5$ cells/well), and measurement of live cells was begun by setting the plate into the xCELLigence Real-Time Cell Analyzer again. The reaction was carried out under the conditions of 5% carbon dioxide gas at 37° C., and from the Cell Index value obtained 72 hours after addition of the human PBMC, the cell growth inhibition rate (%) was determined using the equation below. The Cell Index value used in the calculation was a normalized value where the Cell Index value immediately before antibody addition was defined as 1.

Cell growth inhibition rate (%)=$(A-B) \times 100/(A-1)$

A represents the mean value of the Cell Index values in wells without antibody addition (containing only the target cells and human PBMCs), and B represents the mean value of the Cell Index values in each well. The examinations were performed in triplicate.

When peripheral blood mononuclear cells (PBMCs) prepared from human blood were used as the effector cell to measure the cytotoxicity of GPC3_ERY22_rCE115, a very strong activity was observed (FIG. 2).

Example 2

Humanization of the H Chain of the Anti-CD3 Antibody, rCE115, and Sharing of a Common L Chain (2-1) Design of hCE115HA, the Humanized rCE115 H-Chain Variable Region The H-chain variable region of the rCE115 anti-CD3 antibody (SEQ ID NO:42) was humanized. CDR and FR were determined as defined by Kabat (Kabat numbering).

First, a human FR sequence was selected by comparing the human antibody variable region sequences in a database to the rCE115 rat variable region sequence. The IMGT Database (www.imgt.org/) and NCBI GenBank (www.ncbi.nlm.nih.gov/genbank/) were used for the database. A humanized H-chain variable region sequence was designed by linking the H-chain CDR sequence of the rCE115 variable region with the selected human FR sequence. This yielded a humanized H-chain variable region sequence, hCE115HL (SEQ ID NO:51).

The amino acid residue at position 93 indicated by Kabat numbering is Ala in the selected human H-chain FR3 sequence, but is Arg in the rCE115 variable region sequence. Using the database of rat and human germline sequences (IMGT Database (www.imgt.org/)), only few sequences were found to contain Arg at this site. It is reported that the amino acid residue at position 94 indicated by Kabat numbering contributes to stabilization of the antibody structure by upper core formation (Ewert et al. Methods. 2004 October;34(2):184-99). Based on such information, a humanized H-chain variable region sequence, in which the amino acid residues at Kabat positions 93 and 94 in the H-chain FR3 were substituted with those residues present in the rCE115 variable region sequence, was newly designed. This was the humanized H-chain variable region sequence, hCE115HA (SEQ ID NO:52).

(2-2) Design of the Common L Chain, L0000, for the rCE115 Anti-CD3 Antibody and the Anti-GPC3 Antibody The FR/CDR shuffling of the L-chain variable region rCE115L (SEQ ID NO:43) of the rCE115 anti-CD3 antibody and the L-chain variable region GL4 (SEQ ID NO:41) of the anti-GPC3 antibody was performed.

The FR sequence of GL4 was selected as the L-chain FR sequence. L-chain CDR2 was the same for rCE115L and GL4. The L-chain CDR1 was selected from the CDR sequences of GL4, and the L-chain CDR3 was selected from the CDR sequences of rCE115L, respectively. Furthermore, the L-chain CDR3 produced by substituting the amino acid residue Asp at Kabat position 94 of the selected L-chain CDR3 with the Val residue present in GL4 was newly designed.

A humanized L chain variable region sequence was designed by linking FR and CDR selected above. This yielded a humanized L-chain variable region sequence, L0000 (SEQ ID NO:53).

(2-3) Evaluation of the Affinity for Human GPC3

The activity to bind human GPC3 when using GL4 (SEQ ID NO:41) and L0000 (SEQ ID NO:53) as the L-chain variable regions was evaluated. This was performed using the molecular form of a single-arm antibody having a single Fab at the Fc region of a human IgG1 heterodimerized by the knobs-into-hole technique. H0000 (SEQ ID NO:40) was used for the anti-GPC3 antibody H-chain variable region.

The affinity and binding rate constants of an anti-GPC3 antibody for an antigen were measured by the multi-cycle kinetics method of a surface plasmon resonance assay using Biacore™-T200 (GE Healthcare Japan). HBS-EP+(GE Healthcare Japan) was used for the running buffer, and an amine coupling kit (GE Healthcare Japan) was used to covalently bind Protein A/G to the CM5 chip (carboxymethyl dextran-coated chip). Each anti-GPC3 antibody was prepared so that approximately 100 RU will be captured by Protein A/G. Human GPC3 used as the analyte was prepared at 8, 16, 32, 64, and 128 nM using HBS-EP+. Measurements were carried out by first allowing Protein A/G to capture the antibody solution, and then injecting the human GPC3 solution at a flow rate of 30 µL/min for three minutes to allow reaction to take place. Then, the solution was switched to HBS-EP+ and the dissociation phase was measured for 15 minutes. After completion of the dissociation phase measurement, the sensor chip was regenerated by washing with 10 mM Gly-HCl at pH 1.5. Measurement at the concentration of 0 was similarly carried out by allowing Protein A/G to capture the antibody solution, performing a three-minute HBS-EP+ injection to allow reaction to take place, and then switching to HBS-EP+ to measure the dissociation phase for 15 minutes. After completion of the dissociation phase measurement, the sensor chip was regenerated by washing with 10 mM Gly-HCl at pH 1.5. A data analysis software exclusively for Biacore, Biacore T200 Evaluation Software Version 1.0, was used to perform kinetic analyses to calculate the binding rate constant (ka), dissociation rate constant (kd), and the rate constant ratio from the obtained sensorgrams. The results are shown in Table 6.

TABLE 6

| H-chain variable region | L-chain variable region | Affinity for human GPC3 | | |
|---|---|---|---|---|
| | | KD (M) | ka (1/Ms) | kd (1/s) |
| H0000 | GL4 | $4.2 \times 10^{-9}$ | $4.3 \times 10^{5}$ | $1.8 \times 10^{-3}$ |
| H0000 | L0000 | $3.6 \times 10^{-8}$ | $3.0 \times 10^{5}$ | $1.1 \times 10^{-2}$ |

(2-4) Evaluation of the Affinity for Human CD3

The activity to bind human CD3 when using hCE115HA (SEQ ID NO:52) as the H chain variable region and L0000 (SEQ ID NO:53) as the L-chain variable region was evaluated. This was performed using the molecular form of a single-arm antibody having a single Fab at the Fc region of a human IgG1 heterodimerized by the knobs-into-hole technique.

The affinity and binding rate constants of an anti-CD3 antibody for an antigen were measured by the single-cycle kinetics method of a surface plasmon resonance assay using Biacore™-T200 (GE Healthcare Japan). HBS-EP+(GE Healthcare Japan) was used for the running buffer, and an amine coupling kit (GE Healthcare Japan) was used to covalently bind human CD3 to the CM4 chip (carboxymethyl dextran-coated chip). The anti-CD3 antibody used as the analyte was prepared at 5 and 20 µg/mL using HBS-EP+. Measurements were carried out by first injecting each of the 5- and 20-µg/mL anti-CD3 antibody solutions for three minutes continuously at a flow rate of 20 µL/min to allow reaction to take place. Then, the solution was switched to HBS-EP+ and the dissociation phase was measured for 3 minutes. After completion of the dissociation phase measurement, the sensor chip was regenerated by washing with 10 mM Gly-HCl at pH 1.5. Measurement at the concentration of 0 was carried out by performing each of the three-minute HBS-EP+ injections twice successively to allow reaction to take place, and then switching to HBS-EP+ to measure the dissociation phase for 3 minutes. After completion of the dissociation phase measurement, the sensor chip was regenerated by washing with 10 mM Gly-HCl at pH 1.5.

A data analysis software exclusively for Biacore, Biacore T200 Evaluation Software Version 1.0, was used to perform kinetic analyses to calculate the binding rate constant (ka), dissociation rate constant (kd), and the rate constant ratio from the obtained sensorgrams. The results are shown in Table 7.

TABLE 7

| Variable region | | Affinity for human CD3 | | |
|---|---|---|---|---|
| H-chain variable region | L-chain variable region | KD (M) | ka (1/Ms) | kd (1/s) |
| rCE115H | rCE115L | $1.0 \times 10^{-7}$ | $5.9 \times 10^{4}$ | $6.0 \times 10^{-3}$ |
| hCE115HA | L0000 | $1.2 \times 10^{-7}$ | $1.9 \times 10^{5}$ | $2.3 \times 10^{-2}$ |

(2-5) Preparation of GPC3_ERY27_hCE115

The IgG4 against a cancer antigen (GPC3) was used as the basic structure to produce the ERY27 molecule (FIG. 1B), in which the H-chain variable region of one of the Fabs has been replaced with a CD3 epsilon-binding domain, and the L chain is common to both Fabs. In this case, the IgG4 Fc used as the basic structure was a silent Fc with attenuated affinity for FcgR (an Fcγreceptor). H0000 (SEQ ID NO:40) was used as the H-chain variable region of the GPC3-binding domain, and hCE115HA (SEQ ID NO:52) was used as the H-chain variable region of the CD3-binding domain. L0000 (SEQ ID NO:53) was used as the L-chain variable region. The D356K and K439E mutations introduced into the respective H chains were introduced for efficient heteromer formation of each H chain when producing heterodimeric antibodies comprising two types of H chains (WO 2006/106905). H435R is a modification that interrupts binding to Protein A, and was introduced for efficient separation of the heteromer and homomer (WO/2011/078332).

A series of expression vectors inserted with a polynucleotide encoding each of H0000-ERY27_HK (SEQ ID NO:54), hCE115HA-ERY27_HE (SEQ ID NO:55), and L0000-k0 (SEQ ID NO:56) were produced by well-known methods.

The following combination of expression vectors were introduced into FreeStyle 293-F cells for transient expression of each target molecule.
  Target molecule: GPC3_ERY27_hCE115
  Polypeptides encoded by the polynucleotides inserted into the expression vectors: H0000-ERY27_HK, hCE115HA-ERY27_HE, and L0000-k0

(2-6) Purification of GPC3_ERY27_hCE115

Each molecule of interest was purified by the method described in Example 1-2.

(2-7) Measurement of Cytotoxic Activity Using Human Peripheral Blood Mononuclear Cells (2-7-1) Preparation of a Human Peripheral Blood Mononuclear Cell (PBMC) Solution The solution was prepared by the method described in Example 1-3-1.

(2-7-2) Measurement of Cytotoxic Activity

Cytotoxic activity was measured by the method described in Example 1-3-2.

When PBMCs prepared from human blood were used as the effector cell to measure the cytotoxicity of GPC3_ERY27_hCE115, reduction of the activity was observed as a result of humanization of the H chain of rCE115 and sharing of a common L chain (FIG. 2).

Example 3

Production and Evaluation of Humanized Bispecific Antibody Variants for Improvement of Various Properties The T-cell-dependent cytotoxic activity of the humanized anti-human CD3ε (CD3 epsilon) chain and anti-human GPC3 bispecific antibody obtained in Example 2, GPC3_ERY27_hCE115 (SEQ ID NOs: 54, 55, and 56), was lower than the T-cell-dependent cytotoxic activity of GPC3_ERY22_rCE115 (SEQ ID NOs: 47, 48, 49, and 50). This may be due to attenuation of affinity for GPC3 and the CD3ε chain as a result of humanization and sharing of a common L chain. Regarding GPC3 and CD3ε-chain antigens which have independent sequences, there has been no report so far on humanized bispecific antibodies whose T-cell dependent cytotoxic activity has been enhanced and whose affinity for both antigens has been improved by using a common antibody L chain. Therefore, it has been considered difficult to obtain humanized antibodies with dual specificity that show a drug efficacy equivalent to or greater than that of GPC3_ERY22_rCE115.

Under such circumstances, the Applicants produced modified humanized bispecific antibodies with modified affinity for human GPC3 and human CD3ε chain by methods known to those skilled in the art, which involves comprehensively substituting amino acid residues encoded by the antibody gene to produce antibody variants against both the human GPC3 and human CD3ε-chain antigens, and by performing various evaluations by screening. Furthermore, similar methods were used to produce modified humanized bispecific antibodies with modified physicochemical properties. Furthermore, by combining substitutions of amino acid residues effective for modifying affinity and physicochemical properties, optimized bispecific antibodies having a TDCC activity equivalent to or greater than the T-cell dependent cellular cytotoxicity of GPC3_ERY22_rCE115 prior to humanization were produced.

Introduction of point mutations, expression and purification of antibodies, antigen affinity measurements, and determination of T-cell dependent cellular cytotoxicity in the optimization of humanized bispecific antibodies were performed by methods similar to those in Examples 1 and 2. CDR and FR were determined according to the Kabat definition (Kabat numbering).

Depending on the objective, the following were used as the antibody H-chain constant regions (the numbers indicate EU numbering): E22Hh (SEQ ID NO:57) produced by introducing L234A/L235A/N297A/D356C/T366S/L368A/Y407V/G446 deletion/K447 deletion mutations into human IgG1; E22Hk (SEQ ID NO:58) produced by introducing L234A/L235A/N297A/Y349C/T366W/G446 deletion/K447 deletion mutations and a Ser-Ser insertion mutation immediately before position 118 into human IgG1; G1dh produced by introducing D356C/T366S/L368A/Y407V/G446 deletion/K447 deletion mutations into human IgG1; none-Hi-Kn010G3 produced by introducing 118-215 deletion and C220S/Y349C/T366W/H435R mutations into human IgG1; E2702GsKsc (SEQ ID NO:60) produced by introducing L235R/S239K/N297A/E356K/R409K/H435R/

L445P/G446 deletion/K447 deletion mutations into human IgG4; E2704sEpsc (SEQ ID NO:61) produced by introducing K196Q/L235R/S239K/N297A/R409K/K439E/L445P/G446 deletion/K447 deletion mutations into human IgG4; and E2702sKsc (SEQ ID NO:62) produced by introducing L235R/S239K/N297A/E356K/R409K/L445P/G446 deletion/K447 deletion mutations into human IgG4. Furthermore, human κ (kappa) chain k0 (SEQ ID NO:63) and E22L (SEQ ID NO:432) produced by introducing R108A/T109S mutations into human κ chain were used as the antibody L-chain constant regions.

The mutation that substitutes Cys for Asp at EU numbering position 356, the mutation that substitutes Ser for The at EU numbering position 366, the mutation that substitutes Ala for Leu at EU numbering position 368, the mutation that substitutes Val for Tyr at EU numbering position 407, the mutation that substitutes Cys for Tyr at EU numbering position 349, the mutation that substitutes Trp for Thr at EU numbering position 366, and the mutation that inserts Ser-Ser immediately before position 118 are mutations for efficient formation of heterodimeric molecules for each H chain when producing heteromeric antibodies. Similarly, the mutation that substitutes Lys for Glu at EU numbering position 356 and the mutation that substitutes Glu for Lys at EU numbering position 439 are also mutations for efficient formation of heterodimeric molecules for each H chain when producing heteromeric antibodies. They are expected to improve the efficiency of bispecific antibody production.

The mutation that substitutes Ala for Leu at EU numbering position 234, the mutation that substitutes Ala or Arg for Leu at EU numbering position 235, the mutation that substitutes Lys for Ser at EU numbering position 239, and the mutation that substitutes Ala for Asn at EU numbering position 297 are mutations for attenuating affinity for an Fcγ receptor and a complement (C1q). They are expected to suppress the binding of Fab to CD3 and Fc-mediated cross-linking of an Fcγ receptor or a complement, and avoid cytokine release syndrome that accompanies enhancement of non-specific effector functions.

The H chain introduced with deletion mutations at EU numbering positions 118 to 215 can be combined with a full-length H chain sequence to produce an antibody that has only one Fab (monovalent antibody), and it is useful for affinity evaluation.

The mutation that substitutes Lys for Arg at EU numbering position 409 and the mutation that substitutes Arg for His at EU numbering position 435 are mutations for modifying the antibody properties to be close to the properties of human IgG1 and human IgG3, respectively.

(3-1) Modifying the Affinity of a Humanized Anti-CD3 Antibody by Point Mutations First, point mutations were introduced into FR1, FR2, FR3, CDR1, CDR2, and CDR3 of the humanized anti-human CD3ε chain antibody sequence produced in Example 2, hCE115HA-ERY27_HE (SEQ ID NO:55), to prepare modified antibodies. Next, the affinity of these modified antibodies for the soluble human CD3ε chain was determined. Combining sites that have an affinity-enhancing effect yielded modified antibodies having the affinities shown in Table 8.

TABLE 8

| Antibody name | KD (Human CD3) |
|---|---|
| hCE115HA-E22Hh//-Hi-Kn010G3/L0000-k0 | 1.43E−07 |
| TR01H083-E22Hh/none-Hi-Kn010G3/L0212-k0 | 5.86E−11 |
| TR01H040-E22Hh/none-Hi-Kn010G3/L0240-k0 | 2.17E−09 |
| TR01H002-E22Hh/GLS3108-k0/GL4-E22Hk/H0610-E22L | 2.04E−09 |
| TR01H040-E22Hh/none-Hi-Kn010G3/L0212-k0 | 2.17E−09 |
| TR01H040-E22Hh/none-Hi-Kn010G3/L0235-k0 | 2.81E−09 |
| TR01H040-E22Hh/none-Hi-Kn010G3/L0238-k0 | 2.91E−09 |
| TR01H040-E22Hh/none-Hi-Kn010G3/TR01L016-k0 | 2.52E−09 |
| TR01H083-E22Hh/none-Hi-Kn010G3/L0262-k0 | 2.45E−09 |
| TR01H040-E22Hh/none-Hi-Kn010G3/L0207-k0 | 2.60E−09 |
| TR01H040-E22Hh/none-Hi-Kn010G3/L0241-k0 | 3.48E−09 |
| TR01H040-E22Hh/none-Hi-Kn010G3/L0242-k0 | 3.58E−09 |
| TR01H040-E22Hh/none-Hi-Kn010G3/L0206-k0 | 2.90E−09 |
| TR01H040-E22Hh/none-Hi-Kn010G3/TR01L019-k0 | 3.20E−09 |
| TR01H080-E22Hh/none-Hi-Kn010G3/L0000-k0 | 3.25E−09 |
| TR01H040-E22Hh/none-Hi-Kn010G3/L0211-k0 | 3.22E−09 |
| TR01H002-E22Hh//-Hi-Kn010G3/GLC3108-k0 | 4.61E−09 |
| TR01H040-E22Hh/none-Hi-Kn010G3/L0209-k0 | 4.25E−09 |
| TR01H040-E22Hh/none-Hi-Kn010G3/L0208-k0 | 4.16E−09 |
| TR01H040-E22Hh/none-Hi-Kn010G3/L0224-k0 | 5.06E−09 |
| TR01H040-E22Hh/none-Hi-Kn010G3/L0236-k0 | 5.64E−09 |
| TR01H083-E22Hh/none-Hi-Kn010G3/L0201-k0 | 4.42E−09 |
| TR01H084-E2702GsKsc/none-Hi-E2704sE/L0011-k0 | 4.14E−09 |
| TR01H040-E22Hh/none-Hi-Kn010G3/L0210-k0 | 5.06E−09 |
| TR01H114-E2702GsKsc/none-Hi-E2704sE/L0011-k0 | 4.22E−09 |
| CE115HA236-E22Hh/GLS3108-k0/GL4-E22Hk/H0610-E22L | 6.08E−09 |
| TR01H077-E22Hh/none-Hi-Kn010G3/L0200-k0 | 6.12E−09 |
| TR01H071-E22Hh/none-Hi-Kn010G3/L0200-k0 | 6.13E−09 |
| TR01H111-E2702GsKsc/none-Hi-E2704sE/L0011-k0 | 4.91E−09 |
| TR01H081-E22Hh/none-Hi-Kn010G3/L0262-k0 | 5.76E−09 |
| TR01H001-E22Hh//-Hi-Kn010G3/GLC3108-k0 | 8.22E−09 |
| CE115HA179-G1dh//-Hi-Kn010G3/L0000-k0 | 8.35E−09 |
| TR01H112-E2702GsKsc/none-Hi-E2704sE/L0011-k0 | 5.12E−09 |
| TR01H113-E2702GsKsc/none-Hi-E2704sE/L0011-k0 | 5.14E−09 |
| TR01H082-E22Hh/none-Hi-Kn010G3/L0212-k0 | 4.75E−09 |
| CE115HA236-E22Hh//-Hi-Kn010G3/GLC3108-k0 | 9.10E−09 |
| TR01H040-E22Hh/none-Hi-Kn010G3/L0231-k0 | 7.75E−09 |
| TR01H037-E22Hh/none-Hi-Kn010G3/L0000-k0 | 6.93E−09 |
| CE115HA252-E22Hh//-Hi-Kn010G3/L0000-k0 | 9.48E−09 |
| TR01H083-E22Hh/none-Hi-Kn010G3/L0011-k0 | 6.70E−09 |
| TR01H040-E22Hh/none-Hi-Kn010G3/L0223-k0 | 8.15E−09 |
| TR01H083-E22Hh/none-Hi-Kn010G3/L0000-k0 | 6.83E−09 |
| TR01H071-E22Hh/none-Hi-Kn010G3/L0000-k0 | 8.85E−09 |
| TR01H087-E22Hh/none-Hi-Kn010G3/L0212-k0 | 5.88E−09 |
| CE115HA178-G1dh//-Hi-Kn010G3/L0000-k0 | 1.09E−08 |
| TR01H040-E22Hh/none-Hi-Kn010G3/L0237-k0 | 1.02E−08 |
| TR01H083-E22Hh/none-Hi-Kn010G3/L0222-k0 | 9.42E−09 |
| TR01H084-E22Hh/none-Hi-Kn010G3/L0262-k0 | 8.51E−09 |
| TR01H071-E22Hh/none-Hi-Kn010G3/L0215-k0 | 9.51E−09 |
| TR01H040-E22Hh/none-Hi-Kn010G3/L0218-k0 | 8.20E−09 |
| TR01H081-E22Hh/none-Hi-Kn010G3/L0201-k0 | 9.46E−09 |
| TR01H071-E22Hh/none-Hi-Kn010G3/L0222-k0 | 1.04E−08 |
| TR01H040-E22Hh/none-Hi-Kn010G3/L0220-k0 | 9.15E−09 |
| TR01H067-E22Hh/none-Hi-Kn010G3/TR01L016-k0 | 1.09E−08 |
| TR01H002-E22Hh/GLS3108-k0/GL4-E22Hk/H0000-E22L | 4.76E−08 |
| TR01H067-E22Hh/none-Hi-Kn010G3/TR01L019-k0 | 1.21E−08 |
| TR01H038-E22Hh/none-Hi-Kn010G3/L0000-k0 | 1.24E−08 |
| TR01H061-E22Hh/none-Hi-Kn010G3/L0200-k0 | 1.27E−08 |
| TR01H082-E2702GsKsc/none-Hi-E2704sE/L0011-k0 | 1.01E−08 |
| CE115HA180-G1dh//-Hi-Kn010G3/L0000-k0 | 1.68E−08 |
| CE115HA251-E22Hh/L0000-k0/GL4-E22Hk/H0610-E22L | 1.37E−08 |
| TR01H100-E2702GsKsc/none-Hi-E2704sE/L0011-k0 | 1.11E−08 |
| TR01H040-E22Hh/none-Hi-Kn010G3/L0228-k0 | 1.60E−08 |
| TR01H081-E22Hh/none-Hi-Kn010G3/L0011-k0 | 1.35E−08 |
| TR01H061-E22Hh/none-Hi-Kn010G3/L0215-k0 | 1.54E−08 |
| TR01H110-E2702GsKsc/none-Hi-E2704sE/L0011-k0 | 1.26E−08 |
| TR01H043-E22Hh/none-Hi-Kn010G3/L0000-k0 | 1.52E−08 |
| TR01H081-E22Hh/none-Hi-Kn010G3/L0000-k0 | 1.56E−08 |
| CE115HA251-E22Hh//-Hi-Kn010G3/L0000-k0 | 2.23E−08 |
| TR01H091-E2702GsKsc/none-Hi-E2704sE/L0011-k0 | 1.39E−08 |
| CE115HA236-E22Hh/GLS3108-k0/GL4-E22Hk/H0000-E22L | 6.95E−09 |
| TR01H084-E22Hh/none-Hi-Kn010G3/L0201-k0 | 1.65E−08 |
| TR01H072-E22Hh/none-Hi-Kn010G3/L0000-k0 | 2.03E−08 |
| TR01H099-E2702GsKsc/none-Hi-E2704sE/L0011-k0 | 1.46E−08 |
| TR01H061-E22Hh/none-Hi-Kn010G3/L0222-k0 | 1.88E−08 |
| TR01H040-E22Hh/none-Hi-Kn010G3/L0239-k0 | 2.31E−08 |

TABLE 8-continued

| Antibody name | KD (Human CD3) |
|---|---|
| TR01H040-E22Hh/none-Hi-Kn010G3/L0262-k0 | 1.81E−08 |
| TR01H040-E22Hh/none-Hi-Kn010G3/L0234-k0 | 2.40E−08 |
| TR01H012-E22Hh/none-Hi-Kn010G3/L0000-k0 | 7.94E−09 |
| TR01H061-E22Hh/none-Hi-Kn010G3/L0000-k0 | 1.71E−08 |
| TR01H040-E22Hh/none-Hi-Kn010G3/L0243-k0 | 2.46E−08 |
| TR01H109-E2702GsKsc/none-Hi-E2704sE/L0011-k0 | 1.64E−08 |
| TR01H047-E22Hh/none-Hi-Kn010G3/L0000-k0 | 2.04E−08 |
| TR01H082-E22Hh/none-Hi-Kn010G3/L0267-k0 | 2.29E−08 |
| TR01H082-E22Hh/none-Hi-Kn010G3/L0266-k0 | 2.29E−08 |
| TR01H084-E22Hh/none-Hi-Kn010G3/L0011-k0 | 1.98E−08 |
| TR01H040-E22Hh/none-Hi-Kn010G3/L0250-k0 | 2.15E−08 |
| TR01H040-E22Hh/none-Hi-Kn010G3/L0204-k0 | 2.21E−08 |
| TR01H084-E22Hh/none-Hi-Kn010G3/L0000-k0 | 2.13E−08 |
| TR01H040-E22Hh/none-Hi-Kn010G3/L0213-k0 | 2.01E−08 |
| hCE115HA-E22Hh//-Hi-Kn010G3/L0000-k0 | 1.43E−07 |
| TR01H040-E22Hh/none-Hi-Kn010G3/L0214-k0 | 2.02E−08 |
| TR01H040-E22Hh/none-Hi-Kn010G3/L0217-k0 | 2.07E−08 |
| TR01H071-E22Hh/none-Hi-Kn010G3/L0226-k0 | 2.51E−08 |
| TR01H040-E22Hh/none-Hi-Kn010G3/L0200-k0 | 2.87E−08 |
| TR01H074-E22Hh/none-Hi-Kn010G3/L0000-k0 | 2.91E−08 |
| TR01H039-E22Hh/none-Hi-Kn010G3/L0000-k0 | 2.61E−08 |
| CE115HA177-G1dh//-Hi-Kn010G3/L0000-k0 | 3.55E−08 |
| TR01H040-E22Hh/none-Hi-Kn010G3/L0201-k0 | 2.81E−08 |
| TR01H082-E22Hh/none-Hi-Kn010G3/L0263-k0 | 3.09E−08 |
| TR01H040-E22Hh/none-Hi-Kn010G3/L0000-k0 | 3.60E−08 |
| TR01H040-E22Hh/none-Hi-Kn010G3/L0216-k0 | 2.53E−08 |
| TR01H051-E22Hh/none-Hi-Kn010G3/L0000-k0 | 2.91E−08 |
| TR01H003-E22Hh//-Hi-Kn010G3/L0000-k0 | 4.03E−08 |
| TR01H082-E22Hh/none-Hi-Kn010G3/L0264-k0 | 3.44E−08 |
| TR01H040-E22Hh/none-Hi-Kn010G3/L0232-k0 | 3.86E−08 |
| TR01H041-E22Hh/none-Hi-Kn010G3/L0000-k0 | 3.16E−08 |
| CE115HA122-E22Hh//-Hi-Kn010G3/L0000-k0 | 4.28E−08 |
| TR01H040-E22Hh/none-Hi-Kn010G3/L0233-k0 | 4.01E−08 |
| TR01H040-E22Hh/none-Hi-Kn010G3/L0215-k0 | 3.37E−08 |
| TR01H040-E22Hh/none-Hi-Kn010G3/L0203-k0 | 3.24E−08 |
| TR01H015-E2702GsKsc/GCH019-E2704sEpsc/L0000-k0 | 2.96E−08 |
| TR01H040-E22Hh/none-Hi-Kn010G3/TR01L008-k0 | 2.93E−08 |
| TR01H040-E22Hh/none-Hi-Kn010G3/L0205-k0 | 3.42E−08 |
| TR01H015-E22Hh/L0000-k0/GL4-E22Hk/H0610-E22L | 3.57E−08 |
| TR01H064-E22Hh/none-Hi-Kn010G3/L0000-k0 | 3.07E−08 |
| TR01H044-E22Hh/none-Hi-Kn010G3/L0000-k0 | 3.52E−08 |
| TR01H082-E22Hh/none-Hi-Kn010G3/L0262-k0 | 3.98E−08 |
| TR01H062-E22Hh/none-Hi-Kn010G3/L0000-k0 | 3.13E−08 |
| CE115HA251-E22Hh/L0000-k0/GL4-E22Hk/H0000-E22L | 1.48E−08 |
| TR01H040-E22Hh/none-Hi-Kn010G3/L0011-k0 | 3.48E−08 |
| TR01H040-E22Hh/none-Hi-Kn010G3/L0222-k0 | 4.65E−08 |
| CE115HA192-E22Hh//-Hi-Kn010G3/L0000-k0 | 5.05E−08 |
| TR01H040-E22Hh/none-Hi-Kn010G3/TR01L010-k0 | 3.28E−08 |
| TR01H025-E22Hh/none-Hi-Kn010G3/L0000-k0 | 3.86E−08 |
| TR01H082-E22Hh/none-Hi-Kn010G3/TR01L023-k0 | 4.25E−08 |
| TR01H082-E22Hh/none-Hi-Kn010G3/TR01L015-k0 | 3.95E−08 |
| TR01H055-E22Hh/none-Hi-Kn010G3/L0000-k0 | 3.88E−08 |
| TR01H082-E22Hh/none-Hi-Kn010G3/L0260-k0 | 4.53E−08 |
| TR01H040-E22Hh/none-Hi-Kn010G3/TR01L009-k0 | 3.56E−08 |
| TR01H040-E22Hh/none-Hi-Kn010G3/TR01L011-k0 | 3.57E−08 |
| TR01H017-E22Hh/none-Hi-Kn010G3/L0000-k0 | 3.50E−08 |
| CE115HA122-E22Hh/L0000-k0/GL4-E22Hk/H0000-E22L | 1.69E−08 |
| TR01H076-E22Hh/none-Hi-Kn010G3/L0000-k0 | 4.78E−08 |
| TR01H082-E22Hh/none-Hi-Kn010G3/L0258-k0 | 4.70E−08 |
| TR01H046-E22Hh/none-Hi-Kn010G3/L0000-k0 | 4.23E−08 |
| rCE115H-G1dh//-Hi-Kn010G3/L0000-k0 | 5.76E−08 |
| TR01H082-E22Hh/none-Hi-Kn010G3/TR01L024-k0 | 4.76E−08 |
| TR01H016-E22Hh/none-Hi-Kn010G3/L0000-k0 | 3.69E−08 |
| TR01H040-E22Hh/none-Hi-Kn010G3/TR01L018-k0 | 4.51E−08 |
| TR01H084-E22Hh/none-Hi-Kn010G3/L0271-k0 | 2.76E−08 |
| TR01H084-E22Hh/none-Hi-Kn010G3/L0270-k0 | 2.76E−08 |
| TR01H040-E22Hh/none-Hi-Kn010G3/L0000vk1-k0 | 4.69E−08 |
| TR01H040-E22Hh/none-Hi-Kn010G3/L0219-k0 | 3.94E−08 |
| TR01H014-E22Hh/none-Hi-Kn010G3/L0000-k0 | 3.87E−08 |
| TR01H061-E22Hh/none-Hi-Kn010G3/L0226-k0 | 4.71E−08 |
| TR01H048-E22Hh/none-Hi-Kn010G3/L0000-k0 | 4.52E−08 |
| TR01H082-E22Hh/none-Hi-Kn010G3/L0259-k0 | 5.07E−08 |
| TR01H028-E22Hh/none-Hi-Kn010G3/L0000-k0 | 4.80E−08 |
| TR01H082-E22Hh/none-Hi-Kn010G3/L0201-k0 | 4.49E−08 |
| TR01H040-E22Hh/none-Hi-Kn010G3/TR01L013-k0 | 4.15E−08 |
| TR01H033-E22Hh/none-Hi-Kn010G3/L0000-k0 | 4.88E−08 |
| hCE115HA-G1dh//-Hi-Kn010G3/L0000-k0 | 6.50E−08 |
| TR01H040-E22Hh/none-Hi-Kn010G3/TR01L012-k0 | 4.22E−08 |
| TR01H065-E22Hh/none-Hi-Kn010G3/L0000-k0 | 4.31E−08 |
| TR01H079-E22Hh/none-Hi-Kn010G3/L0000-k0 | 5.05E−08 |
| TR01H042-E22Hh/none-Hi-Kn010G3/L0000-k0 | 4.48E−08 |
| TR01H063-E22Hh/none-Hi-Kn010G3/L0000-k0 | 4.35E−08 |
| TR01H084-E22Hh/none-Hi-Kn010G3/L0272-k0 | 3.10E−08 |
| CE115HA121-E22Hh//-Hi-Kn010G3/L0000-k0 | 6.76E−08 |
| TR01H026-E22Hh/none-Hi-Kn010G3/L0000-k0 | 5.12E−08 |
| TR01H067-E22Hh/none-Hi-Kn010G3/L0262-k0 | 4.92E−08 |
| TR01H073-E22Hh/none-Hi-Kn010G3/L0000-k0 | 5.97E−08 |
| TR01H045-E22Hh/none-Hi-Kn010G3/L0000-k0 | 5.22E−08 |
| TR01H007-E22Hh/none-Hi-Kn010G3/L0000-k0 | 2.17E−08 |
| TR01H082-E22Hh/none-Hi-Kn010G3/L0203-k0 | 4.07E−08 |
| TR01H032-E22Hh/none-Hi-Kn010G3/L0000-k0 | 5.73E−08 |
| TR01H006-E22Hh/none-Hi-Kn010G3/L0000-k0 | 2.30E−08 |
| TR01H013-E22Hh/none-Hi-Kn010G3/L0000-k0 | 4.94E−08 |
| TR01H050-E22Hh/none-Hi-Kn010G3/L0000-k0 | 5.76E−08 |
| TR01H067-E22Hh/none-Hi-Kn010G3/L0200-k0 | 6.03E−08 |
| TR01H015-E22Hh/none-Hi-Kn010G3/L0000-k0 | 6.13E−08 |
| hCE115HA-E22Hh/L0000-k0/GL4-E22Hk/H0000-E22L | 6.16E−08 |
| hCE115HA-E22stHh/none-Hi-stKn010G3/L0000-k0 | 5.17E−08 |
| TR01H069-E22Hh/none-Hi-Kn010G3/L0000-k0 | 7.11E−08 |
| TR01H015-E22Hh/none-Hi-Kn010G3/TR01L003-k0 | 6.34E−08 |
| TR01H040-E22Hh/none-Hi-Kn010G3/L0202-k0 | 6.19E−08 |
| TR01H067-E22Hh/none-Hi-Kn010G3/L0201-k0 | 5.93E−08 |
| TR01H020-E22Hh/none-Hi-Kn010G3/L0000-k0 | 6.48E−08 |
| TR01H082-E22Hh/none-Hi-Kn010G3/L0011-k0 | 5.95E−08 |
| hCE115HA-E22Hh//-Hi-Kn010G3/L0000-k0 | 1.43E−07 |
| TR01H082-E22Hh/none-Hi-Kn010G3/TR01L018-k0 | 4.72E−08 |
| TR01H015-E22Hh/none-Hi-Kn010G3/TR01L005-k0 | 6.53E−08 |
| TR01H052-E22Hh/none-Hi-Kn010G3/L0000-k0 | 6.27E−08 |
| TR01H036-E22Hh/none-Hi-Kn010G3/L0000-k0 | 6.50E−08 |
| TR01H067-E22Hh/none-Hi-Kn010G3/L0203-k0 | 4.79E−08 |
| TR01H030-E22Hh/none-Hi-Kn010G3/L0000-k0 | 6.54E−08 |
| TR01H015-E22Hh/none-Hi-Kn010G3/TR01L001-k0 | 6.56E−08 |
| TR01H100-E22Hh/none-Hi-Kn010G3/L0011-k0 | 6.25E−08 |
| TR01H029-E22Hh/none-Hi-Kn010G3/L0000-k0 | 6.70E−08 |
| TR01H019-E22Hh/none-Hi-Kn010G3/L0000-k0 | 6.85E−08 |
| TR01H082-E22Hh/none-Hi-Kn010G3/L0000-k0 | 7.37E−08 |
| TR01H018-E22Hh/none-Hi-Kn010G3/L0000-k0 | 6.93E−08 |
| TR01H027-E22Hh/none-Hi-Kn010G3/L0000-k0 | 6.95E−08 |
| TR01H049-E22Hh/none-Hi-Kn010G3/L0000-k0 | 6.79E−08 |
| TR01H066-E22Hh/none-Hi-Kn010G3/L0000-k0 | 6.02E−08 |
| TR01H091-E22Hh/none-Hi-Kn010G3/L0011-k0 | 6.67E−08 |
| rCE115H-E22Hh/none-Hi-Kn010G3/L0000-k0 | 8.00E−08 |
| TR01H015-E22Hh/none-Hi-Kn010G3/TR01L002-k0 | 7.14E−08 |
| TR01H040-E22Hh/none-Hi-Kn010G3/L0226-k0 | 8.01E−08 |
| TR01H067-E22Hh/none-Hi-Kn010G3/TR01L018-k0 | 5.26E−08 |
| TR01H093-E22Hh/none-Hi-Kn010G3/L0011-k0 | 6.80E−08 |
| TR01H067-E22Hh/none-Hi-Kn010G3/L0215-k0 | 7.41E−08 |
| TR01H015-E22Hh/none-Hi-Kn010G3/TR01L004-k0 | 7.34E−08 |
| TR01H107-E22Hh/none-Hi-Kn010G3/L0011-k0 | 6.91E−08 |
| TR01H105-E22Hh/none-Hi-Kn010G3/L0011-k0 | 6.95E−08 |
| TR01H090-E22Hh/none-Hi-Kn010G3/L0011-k0 | 6.95E−08 |
| TR01H108-E22Hh/none-Hi-Kn010G3/L0011-k0 | 6.98E−08 |
| TR01H094-E22Hh/none-Hi-Kn010G3/L0011-k0 | 7.00E−08 |
| TR01H109-E22Hh/none-Hi-Kn010G3/L0011-k0 | 7.06E−08 |
| TR01H056-E22Hh/none-Hi-Kn010G3/L0000-k0 | 7.32E−08 |
| TR01H031-E22Hh/none-Hi-Kn010G3/L0000-k0 | 7.55E−08 |
| TR01H022-E22Hh/none-Hi-Kn010G3/L0000-k0 | 7.58E−08 |
| TR01H092-E22Hh/none-Hi-Kn010G3/L0011-k0 | 7.21E−08 |
| TR01H067-E22Hh/none-Hi-Kn010G3/L0000-k0 | 7.15E−08 |
| TR01H067-E22Hh/none-Hi-Kn010G3/L0011-k0 | 7.18E−08 |
| TR01H040-E22Hh/none-Hi-Kn010G3/L0248-k0 | 7.89E−08 |
| TR01H009-E22Hh/none-Hi-Kn010G3/L0000-k0 | 3.15E−08 |
| TR01H023-E22Hh/none-Hi-Kn010G3/L0000-k0 | 7.94E−08 |
| TR01H096-E22Hh/none-Hi-Kn010G3/L0011-k0 | 7.47E−08 |
| TR01H040-E22Hh/none-Hi-Kn010G3/TR01L007-k0 | 6.82E−08 |
| TR01H054-E22Hh/none-Hi-Kn010G3/L0000-k0 | 7.79E−08 |
| TR01H021-E22Hh/none-Hi-Kn010G3/L0000-k0 | 8.05E−08 |
| TR01H103-E22Hh/none-Hi-Kn010G3/L0011-k0 | 7.72E−08 |
| TR01H099-E22Hh/none-Hi-Kn010G3/L0011-k0 | 7.74E−08 |
| rCE115H-E22Hh/none-Hi-Kn010G3/L0000vk1-k0 | 8.52E−08 |
| TR01H101-E22Hh/none-Hi-Kn010G3/L0011-k0 | 7.87E−08 |
| TR01H053-E22Hh/none-Hi-Kn010G3/L0000-k0 | 8.23E−08 |

TABLE 8-continued

| Antibody name | KD (Human CD3) |
|---|---|
| TR01H035-E22Hh/none-Hi-Kn010G3/L0000-k0 | 8.49E−08 |
| TR01H067-E22Hh/none-Hi-Kn010G3/TR01L015-k0 | 8.64E−08 |
| TR01H104-E22Hh/none-Hi-Kn010G3/L0011-k0 | 8.26E−08 |
| TR01H075-E22Hh/none-Hi-Kn010G3/L0000-k0 | 9.88E−08 |
| TR01H040-E22Hh/none-Hi-Kn010G3/L0227-k0 | 1.01E−07 |
| TR01H102-E22Hh/none-Hi-Kn010G3/L0011-k0 | 8.54E−08 |
| TR01H034-E22Hh/none-Hi-Kn010G3/L0000-k0 | 9.11E−08 |
| TR01H082-E22Hh/none-Hi-Kn010G3/L0222-k0 | 1.01E−07 |
| rCE115H-E22Hh/rCE115L-k0/GL4-E22Hk/H0000-E22L | 9.37E−08 |
| TR01H015-E22Hh/none-Hi-Kn010G3/TR01L006-k0 | 9.30E−08 |
| TR01H040-E22Hh/none-Hi-Kn010G3/L0246-k0 | 9.28E−08 |
| TR01H097-E22Hh/none-Hi-Kn010G3/L0011-k0 | 8.76E−08 |
| TR01H011-E22Hh/none-Hi-Kn010G3/L0000-k0 | 3.71E−08 |
| TR01H010-E22Hh/none-Hi-Kn010G3/L0000-k0 | 3.73E−08 |
| TR01H095-E22Hh/none-Hi-Kn010G3/L0011-k0 | 9.09E−08 |
| TR01H082-E22Hh/none-Hi-Kn010G3/TR01L020-k0 | 1.06E−07 |
| TR01H098-E22Hh/none-Hi-Kn010G3/L0011-k0 | 9.14E−08 |
| TR01H082-E22Hh/none-Hi-Kn010G3/TR01L017-k0 | 1.09E−07 |
| TR01H040-E22Hh/none-Hi-Kn010G3/L0247-k0 | 1.00E−07 |
| rCE115H-E22Hh/none-Hi-Kn010G3/rCE115L-k0 | 1.24E−07 |
| TR01H004-E22Hh//-Hi-Kn010G3/L0000-k0 | 1.35E−07 |
| TR01H067-E22Hh/none-Hi-Kn010G3/L0222-k0 | 7.63E−08 |
| rCE115H-E22Hh//-Hi-Kn010G3/rCE115L-k0 | 1.38E−07 |
| TR01H008-E22Hh/none-Hi-Kn010G3/L0000-k0 | 4.22E−08 |
| TR01H070-E22Hh/none-Hi-Kn010G3/L0000-k0 | 1.20E−07 |
| TR01H106-E22Hh/none-Hi-Kn010G3/L0011-k0 | 1.00E−07 |
| TR01H024-E22Hh/none-Hi-Kn010G3/L0000-k0 | 1.08E−07 |
| CE115HA124-E22Hh//-Hi-Kn010G3/L0000-k0 | 1.43E−07 |
| TR01H040-E22Hh/none-Hi-Kn010G3/L0249-k0 | 1.11E−07 |
| TR01H082-E22Hh/none-Hi-Kn010G3/L0271-k0 | 6.82E−08 |
| TR01H057-E22Hh/none-Hi-Kn010G3/L0000-k0 | 1.12E−07 |
| TR01H058-E22Hh/none-Hi-Kn010G3/L0000-k0 | 1.15E−07 |
| TR01H068-E22Hh/none-Hi-Kn010G3/L0000-k0 | 1.01E−07 |
| TR01H082-E22Hh/none-Hi-Kn010G3/L0270-k0 | 7.42E−08 |
| TR01H082-E22Hh/none-Hi-Kn010G3/L0272-k0 | 7.44E−08 |
| hCE115HA-E22Hh/none-Hi-Kn010G3/L0000-k0 | 1.24E−07 |
| TR01H082-E22Hh/none-Hi-Kn010G3/L0268-k0 | 1.36E−07 |
| hCE115HAa-E22Hh/none-Hi-Kn010G3/L0000-k0 | 1.08E−07 |
| TR01H067-E22Hh/none-Hi-Kn010G3/L0226-k0 | 1.32E−07 |
| TR01H067-E22Hh/none-Hi-Kn010G3/L0248-k0 | 1.39E−07 |

(3-2) Modifying the Affinity of a Humanized Anti-GPC3 Antibody

First, point mutations were introduced into CDR1, CDR2, and CDR3 of the anti-human GPC3 bispecific antibody sequence produced in Example 2, H0000-ERY27_HK (SEQ ID NO:54), to prepare modified antibodies. Next, the affinity of these modified antibodies for soluble human GPC3 was determined. Combining sites that have an affinity-enhancing effect yielded modified antibodies having the affinities shown in Table 9.

TABLE 9

| Antibody name | KD (Human GPC3) |
|---|---|
| H0610-G1dh/none-Hi-Kn010G3/L0000-k0 | 3.97E−09 |
| H0610-G1dh/none-Hi-Kn010G3/L0222-k0 | 1.40E−13 |
| H0610-G1dh/none-Hi-Kn010G3/L0258-k0 | 3.52E−13 |
| GCH054-G1dh/none-Hi-Kn010G3/L0262-k0 | 5.25E−13 |
| GCH060-G1dh/none-Hi-Kn010G3/L0222-k0 | 6.42E−13 |
| H0610-G1dh/none-Hi-Kn010G3/L0246-k0 | 1.21E−12 |
| GCH057-G1dh/none-Hi-Kn010G3/L0222-k0 | 1.85E−12 |
| GCH054-G1dh/none-Hi-Kn010G3/L0249-k0 | 3.61E−12 |
| GCH055-G1dh/none-Hi-Kn010G3/L0222-k0 | 3.90E−12 |
| GCH094-G1dh/none-Hi-Kn010G3/L0246-k0 | 4.12E−12 |
| H0610-G1dh/none-Hi-Kn010G3/L0249-k0 | 6.86E−12 |
| H0610-G1dh/none-Hi-Kn010G3/TR01L017-k0 | 8.27E−12 |
| H0610-G1dh/none-Hi-Kn010G3/L0265-k0 | 8.70E−12 |
| H0610-G1dh/none-Hi-Kn010G3/L0261-k0 | 1.07E−11 |
| GCH065-G1dh/none-Hi-Kn010G3/L0262-k0 | 1.18E−11 |
| GCH056-G1dh/none-Hi-Kn010G3/L0262-k0 | 1.19E−11 |
| H0610-G1dh/none-Hi-Kn010G3/L0268-k0 | 1.69E−11 |
| H0610-G1dh/none-Hi-Kn010G3/TR01L020-k0 | 2.24E−11 |
| GCH054-G1dh/none-Hi-Kn010G3/L0246-k0 | 3.15E−11 |
| GCH054-G1dh/none-Hi-Kn010G3/L0222-k0 | 3.15E−11 |
| GCH073-G1dh/none-Hi-Kn010G3/L0201-k0 | 3.50E−11 |
| H0610-G1dh/none-Hi-Kn010G3/L0248-k0 | 5.55E−11 |
| GCH065-G1dh/none-Hi-Kn010G3/L0201-k0 | 7.74E−11 |
| H0610-G1dh/none-Hi-Kn010G3/L0226-k0 | 9.30E−11 |
| H0610-G1dh/none-Hi-Kn010G3/L0093-k0 | 1.06E−10 |
| GCH098-G1dh/none-Hi-Kn010G3/L0201-k0 | 1.11E−10 |
| H0610-G1dh/none-Hi-Kn010G3/L0267-k0 | 1.79E−10 |
| H0610-G1dh/none-Hi-Kn010G3/L0228-k0 | 2.02E−10 |
| H0610-G1dh/none-Hi-Kn010G3/L0262-k0 | 2.11E−10 |
| H0610-G1dh/none-Hi-Kn010G3/L0266-k0 | 2.13E−10 |
| H0610-G1dh/none-Hi-Kn010G3/L0264-k0 | 2.19E−10 |
| H0610-G1dh/none-Hi-Kn010G3/L0224-k0 | 2.43E−10 |
| H0610-G1dh/none-Hi-Kn010G3/L0167-k0 | 2.11E−10 |
| CE115HA251-E22Hh/L0000-k0/GL4-E22Hk/H0610-E22L | 2.36E−10 |
| TR01H015-E22Hh/L0000-k0/GL4-E22Hk/H0610-E22L | 2.63E−10 |
| CE115HA236-E22Hh/GLS3108-k0/GL4-E22Hk/H0610-E22L | 2.67E−10 |
| H0610-G1dh/none-Hi-Kn010G3/L0259-k0 | 3.34E−10 |
| H0610-G1dh/none-Hi-Kn010G3/L0227-k0 | 4.08E−10 |
| GCH065-G1dh/none-Hi-Kn010G3/L0272-k0 | 3.93E−10 |
| H0610-G1dh/none-Hi-Kn010G3/L0269-k0 | 4.59E−10 |
| H0610-G1dh/none-Hi-Kn010G3/L0223-k0 | 4.75E−10 |
| TR01H002-E22Hh/GLS3108-k0/GL4-E22Hk/H0610-E22L | 4.75E−10 |
| GCH054-G1dh/none-Hi-Kn010G3/L0212-k0 | 5.17E−10 |
| H0610-G1dh/none-Hi-Kn010G3/L0208-k0 | 5.30E−10 |
| H0610-G1dh/none-Hi-Kn010G3/L0263-k0 | 5.64E−10 |
| H0610-G1dh/none-Hi-Kn010G3/L0231-k0 | 5.89E−10 |
| H0610-G1dh/none-Hi-Kn010G3/L0143-k0 | 5.73E−10 |
| GCH055-G1dh/none-Hi-Kn010G3/L0212-k0 | 6.14E−10 |
| H0610-G1dh/none-Hi-Kn010G3/L0211-k0 | 6.47E−10 |
| H0610-G1dh/none-Hi-Kn010G3/L0238-k0 | 6.37E−10 |
| H0610-G1dh/none-Hi-Kn010G3/L0214-k0 | 6.57E−10 |
| H0610-G1dh/none-Hi-Kn010G3/L0243-k0 | 6.49E−10 |
| GCH025-G1dh/none-Hi-Kn010G3/L0204-k0 | 6.70E−10 |
| GCH054-G1dh/none-Hi-Kn010G3/TR01L016-k0 | 7.63E−10 |
| H0610-G1dh/none-Hi-Kn010G3/L0168-k0 | 6.99E−10 |
| GCH094-G1dh/none-Hi-Kn010G3/L0271-k0 | 6.92E−10 |
| GCH054-G1dh/none-Hi-Kn010G3/TR01L019-k0 | 8.71E−10 |
| H0610-G1dh/none-Hi-Kn010G3/L0234-k0 | 7.78E−10 |
| GCH098-G1dh/none-Hi-Kn010G3/L0011-k0 | 8.02E−10 |
| H0610-G1dh/none-Hi-Kn010G3/L0204-k0 | 7.27E−10 |
| H0610-G1dh/none-Hi-Kn010G3/L0240-k0 | 8.48E−10 |
| H0610-G1dh/none-Hi-Kn010G3/L0239-k0 | 8.74E−10 |
| H0610-G1dh/none-Hi-Kn010G3/L0212-k0 | 9.94E−10 |
| GCH065-G1dh/none-Hi-Kn010G3/L0011-k0 | 8.84E−10 |
| H0610-G1dh/none-Hi-Kn010G3/L0200-k0 | 1.04E−09 |
| H0610-G1dh/none-Hi-Kn010G3/L0124-k0 | 9.72E−10 |
| GCH073-G1dh/none-Hi-Kn010G3/L0011-k0 | 9.10E−10 |
| H0610-G1dh/none-Hi-Kn010G3/TR01L016-k0 | 1.08E−09 |
| GCH054-G1dh/none-Hi-Kn010G3/L0201-k0 | 1.08E−09 |
| H0610-G1dh/none-Hi-Kn010G3/L0090-k0 | 1.12E−09 |
| H0610-G1dh/none-Hi-Kn010G3/L0209-k0 | 1.12E−09 |
| H0610-G1dh/none-Hi-Kn010G3/L0201-k0 | 1.13E−09 |
| H0610-G1dh/none-Hi-Kn010G3/L0161-k0 | 9.73E−10 |
| H0610-G1dh/none-Hi-Kn010G3/L0206-k0 | 8.65E−10 |
| H0610-G1dh/none-Hi-Kn010G3/L0186-k0 | 1.08E−09 |
| H0610-G1dh/none-Hi-Kn010G3/TR01L019-k0 | 1.15E−09 |
| H0610-G1dh/none-Hi-Kn010G3/L0085-k0 | 1.17E−09 |
| GCH055-G1dh/none-Hi-Kn010G3/L0200-k0 | 1.13E−09 |
| H0610-G1dh/none-Hi-Kn010G3/L0154-k0 | 1.01E−09 |
| H0610-G1dh/none-Hi-Kn010G3/L0229-k0 | 1.20E−09 |
| GCH054-G1dh/none-Hi-Kn010G3/L0200-k0 | 1.18E−09 |
| GCH094-G1dh/none-Hi-Kn010G3/L0201-k0 | 1.17E−09 |
| H0610-G1dh/none-Hi-Kn010G3/L0000-k0 | 3.97E−09 |
| H0610-G1dh/none-Hi-Kn010G3/L0205-k0 | 1.01E−09 |
| GCH099-G1dh/none-Hi-Kn010G3/L0201-k0 | 1.29E−09 |
| H0610-G1dh/none-Hi-Kn010G3/L0242-k0 | 1.19E−09 |
| GCH056-G1dh/none-Hi-Kn010G3/L0201-k0 | 1.16E−09 |
| H0610-G1dh/none-Hi-Kn010G3/L0213-k0 | 1.25E−09 |

TABLE 9-continued

| Antibody name | KD (Human GPC3) |
|---|---|
| GCH060-G1dh/none-Hi-Kn010G3/L0200-k0 | 1.34E−09 |
| GCH065-G1dh/none-Hi-Kn010G3/L0000-k0 | 1.41E−09 |
| GCH100-G1dh/none-Hi-Kn010G3/L0201-k0 | 1.37E−09 |
| H0610-G1dh/none-Hi-Kn010G3/L0015-k0 | 1.31E−09 |
| H0610-G1dh/none-Hi-Kn010G3/L0151-k0 | 1.25E−09 |
| H0610-G1dh/none-Hi-Kn010G3/L0237-k0 | 1.31E−09 |
| H0610-G1dh/none-Hi-Kn010G3/L0220-k0 | 1.36E−09 |
| H0610-G1dh/none-Hi-Kn010G3/L0155-k0 | 1.28E−09 |
| GCH055-G1dh/none-Hi-Kn010G3/L0215-k0 | 1.52E−09 |
| H0610-G1dh/none-Hi-Kn010G3/L0202-k0 | 1.22E−09 |
| GCH056-G1dh/none-Hi-Kn010G3/L0215-k0 | 1.59E−09 |
| H0610-G1dh/none-Hi-Kn010G3/L0012-k0 | 1.55E−09 |
| GCH054-G1dh/none-Hi-Kn010G3/L0215-k0 | 1.62E−09 |
| H0610-G1dh/none-Hi-Kn010G3/L0215-k0 | 1.64E−09 |
| GCH098-G1dh/none-Hi-Kn010G3/L0000-k0 | 1.77E−09 |
| H0610-G1dh/none-Hi-Kn010G3/L0125-k0 | 1.71E−09 |
| GCH057-G1dh/none-Hi-Kn010G3/L0215-k0 | 1.83E−09 |
| H0610-G1dh/none-Hi-Kn010G3/L0217-k0 | 1.79E−09 |
| H0610-G1dh/none-Hi-Kn010G3/L0014-k0 | 1.82E−09 |
| H0610-G1dh/none-Hi-Kn010G3/L0216-k0 | 1.86E−09 |
| TR01H015-E2702GsKsc/GCH019-E2704sEpscL0000-k0 | 1.64E−09 |
| H0610-G1dh/none-Hi-Kn010G3/TR01L015-k0 | 2.16E−09 |
| H0610-G1dh/none-Hi-Kn010G3/TR01L018-k0 | 2.17E−09 |
| H0610-G1dh/none-Hi-Kn010G3/L0218-k0 | 1.99E−09 |
| H0610-G1dh/none-Hi-Kn010G3/L0000vk1-k0 | 2.16E−09 |
| H0610-G1dh/none-Hi-Kn010G3/L0160-k0 | 2.12E−09 |
| H0610-G1dh/none-Hi-Kn010G3/L0047-k0 | 2.23E−09 |
| GCH073-G1dh/none-Hi-Kn010G3/L0000-k0 | 2.00E−09 |
| GCH054-G1dh/none-Hi-Kn010G3/TR01L015-k0 | 2.45E−09 |
| H0610-G1dh/none-Hi-Kn010G3/L0219-k0 | 2.28E−09 |
| GCH094-G1dh/none-Hi-Kn010G3/L0272-k0 | 2.10E−09 |
| H0610-G1dh/none-Hi-Kn010G3/L0149-k0 | 2.16E−09 |
| GCH054-G1dh/none-Hi-Kn010G3/TR01L018-k0 | 2.59E−09 |
| GCH054-G1dh/none-Hi-Kn010G3/L0203-k0 | 2.48E−09 |
| H0610-G1dh/none-Hi-Kn010G3/L0122-k0 | 2.42E−09 |
| H0610-G1dh/none-Hi-Kn010G3/L0134-k0 | 2.53E−09 |
| H0610-G1dh/none-Hi-Kn010G3/L0152-k0 | 2.36E−09 |
| H0610-G1dh/none-Hi-Kn010G3/L0203-k0 | 2.11E−09 |
| H0610-G1dh/none-Hi-Kn010G3/L0075-k0 | 2.85E−09 |
| H0610-G1dh/none-Hi-Kn010G3/L0038-k0 | 2.75E−09 |
| H0610-G1dh/none-Hi-Kn010G3/L0011-k0 | 2.76E−09 |
| H0610-G1dh/none-Hi-Kn010G3/L0157-k0 | 2.60E−09 |
| H0610-G1dh/none-Hi-Kn010G3/L0145-k0 | 2.66E−09 |
| H0610-G1dh/none-Hi-Kn010G3/TR01L010-k0 | 2.92E−09 |
| H0610-G1dh/none-Hi-Kn010G3/L0009-k0 | 2.99E−09 |
| GCH099-G1dh/none-Hi-Kn010G3/L0011-k0 | 2.78E−09 |
| H0610-G1dh/none-Hi-Kn010G3/L0006-k0 | 3.04E−09 |
| H0610-G1dh/none-Hi-Kn010G3/L0173-k0 | 2.83E−09 |
| H0610-G1dh/none-Hi-Kn010G3/L0127-k0 | 3.12E−09 |
| H0610-G1dh/none-Hi-Kn010G3/L0082-k0 | 3.43E−09 |
| H0610-G1dh/none-Hi-Kn010G3/L0064-k0 | 3.37E−09 |
| H0610-G1dh/none-Hi-Kn010G3/L0008-k0 | 3.30E−09 |
| H0610-G1dh/none-Hi-Kn010G3/L0013-k0 | 3.35E−09 |
| H0610-G1dh/none-Hi-Kn010G3/L0140-k0 | 3.38E−09 |
| H0610-G1dh/none-Hi-Kn010G3/L0039-k0 | 3.41E−09 |
| GCH043-G1dh/none-Hi-Kn010G3/L0000-k0 | 3.74E−09 |
| H0610-G1dh/none-Hi-Kn010G3/TR01L008-k0 | 3.48E−09 |
| H0610-G1dh/none-Hi-Kn010G3/L0148-k0 | 3.28E−09 |
| GCH062-G1dh/none-Hi-Kn010G3/L0000-k0 | 3.73E−09 |
| H0610-G1dh/none-Hi-Kn010G3/L0163-k0 | 3.38E−09 |
| H0610-G1dh/none-Hi-Kn010G3/L0233-k0 | 3.55E−09 |
| H0610-G1dh/none-Hi-Kn010G3/L0230-k0 | 4.00E−09 |
| GCH006-G1dh/none-Hi-Kn010G3/L0000-k0 | 4.06E−09 |
| H0610-G1dh/none-Hi-Kn010G3/L0032-k0 | 3.72E−09 |
| H0610-G1dh/none-Hi-Kn010G3/L0181-k0 | 3.51E−09 |
| H0610-G1dh/none-Hi-Kn010G3/TR01L009-k0 | 3.81E−09 |
| H0610-G1dh/none-Hi-Kn010G3/L0141-k0 | 3.86E−09 |
| H0610-G1dh/none-Hi-Kn010G3/L0079-k0 | 4.23E−09 |
| GCH094-G1dh/none-Hi-Kn010G3/L0270-k0 | 3.60E−09 |
| GCH066-G1dh/none-Hi-Kn010G3/L0000-k0 | 4.29E−09 |
| GCH064-G1dh/none-Hi-Kn010G3/L0000-k0 | 4.14E−09 |
| H0610-G1dh/none-Hi-Kn010G3/L0066-k0 | 4.20E−09 |
| GCH027-G1dh/none-Hi-Kn010G3/L0000-k0 | 3.83E−09 |
| H0610-G1dh/none-Hi-Kn010G3/L0003-k0 | 4.01E−09 |
| H0610-G1dh/none-Hi-Kn010G3/L0042-k0 | 4.27E−09 |
| H0610-G1dh/none-Hi-Kn010G3/TR01L011-k0 | 4.02E−09 |
| H0610-G1dh/none-Hi-Kn010G3/L0000-k0 | 3.97E−09 |
| GCH015-G1dh/none-Hi-Kn010G3/L0000-k0 | 4.14E−09 |
| H0610-G1dh/none-Hi-Kn010G3/L0175-k0 | 3.84E−09 |
| GCH100-G1dh/none-Hi-Kn010G3/L0011-k0 | 3.81E−09 |
| GCH014-G1dh/none-Hi-Kn010G3/L0000-k0 | 4.20E−09 |
| GCH053-G1dh/none-Hi-Kn010G3/L0000-k0 | 4.05E−09 |
| hCE115HA-E22Hh/L0000-k0/GL4-E22Hk/H0000-E22L | 4.28E−09 |
| GCH094-G1dh/none-Hi-Kn010G3/L0011-k0 | 3.88E−09 |
| GCH045-G1dh/none-Hi-Kn010G3/L0000-k0 | 4.63E−09 |
| H0610-G1dh/none-Hi-Kn010G3/TR01L012-k0 | 4.25E−09 |
| H0610-G1dh/none-Hi-Kn010G3/L0115-k0 | 4.34E−09 |
| H0610-G1dh/none-Hi-Kn010G3/L0044-k0 | 4.57E−09 |
| H0610-G1dh/none-Hi-Kn010G3/L0107-k0 | 4.38E−09 |
| H0610-G1dh/none-Hi-Kn010G3/L0007-k0 | 4.39E−09 |
| GCH013-G1dh/none-Hi-Kn010G3/L0000-k0 | 4.44E−09 |
| H0610-G1dh/none-Hi-Kn010G3/L0045-k0 | 4.66E−09 |
| GCH010-G1dh/none-Hi-Kn010G3/L0000-k0 | 4.12E−09 |
| GCH040-G1dh/none-Hi-Kn010G3/L0000-k0 | 4.80E−09 |
| H0610-G1dh/none-Hi-Kn010G3/L0002-k0 | 4.43E−09 |
| H0610-G1dh/none-Hi-Kn010G3/L0016-k0 | 4.44E−09 |
| GCH007-G1dh/none-Hi-Kn010G3/L0000-k0 | 4.93E−09 |
| GCH042-G1dh/none-Hi-Kn010G3/L0000-k0 | 4.89E−09 |
| rCE115H-E22Hh/rCE115L-k0/GL4-E22Hk/H0000-E22L | 4.57E−09 |
| H0610-G1dh/none-Hi-Kn010G3/L0129-k0 | 4.54E−09 |
| H0610-G1dh/none-Hi-Kn01G3/L0065-k0 | 4.79E−09 |
| GCH016-G1dh/none-Hi-Kn010G3/L0000-k0 | 4.59E−09 |
| GCH035-G1dh/none-Hi-Kn010G3/L0000-k0 | 4.94E−09 |
| GCH039-G1dh/none-Hi-Kn010G3/L0000-k0 | 4.95E−09 |
| GCH099-G1dh/none-Hi-kn010G3/L0000-k0 | 4.24E−09 |
| H0610-G1dh/none-Hi-Kn010G3/L0041-k0 | 4.85E−09 |
| GCH019-G1dh/none-Hi-Kn010G3/L0000-k0 | 4.36E−09 |
| GCH029-G1dh/none-Hi-Kn010G3/L0000-k0 | 5.01E−09 |
| GCH056-G1dh/none-Hi-Kn010G3/L0011-k0 | 4.31E−09 |
| H0610-G1dh/none-Hi-Kn010G3/L0147-k0 | 4.38E−09 |
| GCH034-G1dh/none-Hi-Kn010G3/L0000-k0 | 5.09E−09 |
| GCH003-G1dh/none-Hi-Kn010G3/L0000-k0 | 5.20E−09 |
| H0610-G1dh/none-Hi-Kn010G3/L0139-k0 | 4.78E−09 |
| H0610-G1dh/none-Hi-Kn010G3/L0089-k0 | 5.24E−09 |
| H0610-G1dh/none-Hi-Kn010G3/L0113-k0 | 4.82E−09 |
| H0610-G1dh/none-Hi-Kn010G3/L0180-k0 | 4.48E−09 |
| GCH005-G1dh/none-Hi-Kn010G3/L0000-k0 | 5.32E−09 |
| GCH067-G1dh/none-Hi-Kn010G3/L0000-k0 | 5.24E−09 |
| H0610-G1dh/none-Hi-Kn010G3/L0187-k0 | 4.92E−09 |
| H0610-G1dh/none-Hi-Kn010G3/L0043-k0 | 5.14E−09 |
| H0610-G1dh/none-Hi-Kn010G3/L0117-k0 | 4.92E−09 |
| GCH061-G1dh/none-Hi-Kn010G3/L0000-k0 | 5.13E−09 |
| GCH022-G1dh/none-Hi-Kn010G3/L0000-k0 | 4.92E−09 |
| H0610-G1dh/none-Hi-Kn010G3/L0091-k0 | 5.43E−09 |
| GCH023-G1dh/none-Hi-Kn010G3/L0000-k0 | 4.94E−09 |
| H0610-G1dh/none-Hi-Kn010G3/L0062-k0 | 5.28E−09 |
| H0610-G1dh/none-Hi-Kn010G3/L0136-k0 | 5.04E−09 |
| H0610-G1dh/none-Hi-Kn010G3/TR01L003-k0 | 5.08E−09 |
| H0610-G1dh/none-Hi-Kn010G3/L0069-k0 | 5.32E−09 |
| H0610-G1dh/none-Hi-Kn010G3/L0123-k0 | 5.08E−09 |
| GCH025-G1dh/none-Hi-Kn010G3/L0000-k0 | 5.05E−09 |
| GCH100-G1dh/none-Hi-Kn010G3/L0000-k0 | 5.39E−09 |
| H0610-G1dh/none-Hi-Kn010G3/L0046-k0 | 5.45E−09 |
| H0610-G1dh/none-Hi-Kn010G3/L0144-k0 | 4.84E−09 |
| GCH026-G1dh/none-Hi-Kn010G3/L0000-k0 | 5.17E−09 |
| H0610-G1dh/none-Hi-Kn010G3/L0138-k0 | 5.24E−09 |
| GCH056-G1dh/none-Hi-Kn010G3/L0000-k0 | 5.03E−09 |
| H0610-G1dh/none-Hi-Kn010G3/L0129-k0 | 5.28E−09 |
| GCH032-G1dh/none-Hi-Kn010G3/L0000-k0 | 5.74E−09 |
| H0610-G1dh/none-Hi-Kn010G3/TR01L005-k0 | 5.37E−09 |
| GCH012-G1dh/none-Hi-Kn010G3/L0000-k0 | 5.40E−09 |
| GCH055-G1dh/none-Hi-Kn010G3/L0000-k0 | 5.60E−09 |
| H0610-G1dh/none-Hi-Kn010G3/L0104-k0 | 5.90E−09 |
| GCH059-G1dh/none-Hi-Kn010G3/L0000-k0 | 5.70E−09 |
| GCH054-G1dh/none-Hi-Kn010G3/L0000-k0 | 5.30E−09 |
| GCH008-G1dh/none-Hi-Kn010G3/L0000-k0 | 5.55E−09 |
| H0610-G1dh/none-Hi-Kn010G3/L0232-k0 | 5.38E−09 |
| H0610-G1dh/none-Hi-Kn010G3/L0126-k0 | 5.62E−09 |
| GCH094-G1dh/none-Hi-Kn010G3/L0000-k0 | 5.89E−09 |
| H0610-G1dh/none-Hi-Kn010G3/L0132-k0 | 5.65E−09 |
| H0610-G1dh/none-Hi-kn010G3/L0106-k0 | 5.66E−09 |
| GCH054-G1dh/none-Hi-Kn010G3/L0011-k0 | 5.25E−09 |

TABLE 9-continued

| Antibody name | KD (Human GPC3) |
|---|---|
| H0610-G1dh/none-Hi-Kn010G3/L0109-k0 | 5.70E−09 |
| H0610-G1dh/none-Hi-Kn010G3/L0063-k0 | 6.03E−09 |
| GCH068-G1dh/none-Hi-Kn010G3/L0000-k0 | 6.23E−09 |
| GCH057-G1dh/none-Hi-Kn010G3/L0000-k0 | 5.61E−09 |
| H0610-G1dh/none-Hi-kn010G3/L0137-k0 | 5.87E−09 |

(3-3) Modification of pI by Point Mutations

In commercial production of bispecific antibodies, a high level of purity is required. When using ion-exchange chromatography, modifying the molecular isoelectric point (pI) has been reported to be effective (PLoS One. 2013; 8(2): e57479). Therefore, point mutations for pI modifications were introduced into CDR1, CDR2, and CDR3 of the humanized anti-human GPC3 antibody sequence produced in Example 2, H0000-ERY27_HK (SEQ ID NO:54), to prepare modified antibodies. Next, the affinity of these modified antibodies for soluble human GPC3 was determined.

As a result, amino acid modifications that can lower the pI while maintaining the affinity for human GPC3 were found to be amino acids at positions 19, 43, 53, and 61 according to Kabat numbering.

Combination of sites showing effects of maintaining the affinity for human GPC3 and lowering the pI yielded antibodies having the affinities and pI values shown in Table 10.

(3-4) Modifying the Extracellular Matrix-binding Ability by Point Mutation

It has been reported that non-specific binding to the extracellular matrix (ECM) and such may have effects on pharmacokinetics (MAbs. 2012 November-December; 4(6): 753-60). Therefore, the ECM-binding ability of the modified antibodies obtained in the Examples was determined by the method described in Reference Example 4. As a result, the humanized anti-human CD3ε chain and anti-human GPC3 bispecific antibody, GPC3_ERY27_hCE115 (SEQ ID NOs: 54, 55, and 56), were confirmed to have high ECM-binding abilities. Therefore, any of the point mutations examined in Examples 3-1, 3-2, and 3-3 for the humanized anti-human CD3ε chain antibody sequence hCE115HA-ERY27 RE (SEQ ID NO:55) was investigated to be a combination for reducing the ECM-binding ability. As a result, amino acids at positions 11, 16, 52a, 53, 98, and 100 by Kabat numbering were found to contribute to the maintenance of affinity for CD3ε and to have influence on the reduction of the ECM-binding ability, and antibodies with a reduced ECM-binding ability in comparison to that of an antibody variant of the humanized anti-human CD3ε chain and anti-human GPC3 bispecific antibody, GPC3_ERY27_hCE115, were obtained (Table 11).

TABLE 10

| Antibody name (homomeric antibody) | Calculated pI value (homomeric antibody) | Antibody name (single-arm antibody) | human GPC3 KD (single-arm antibody) | Mutation sites based on H0610-E2704sEpsc |
|---|---|---|---|---|
| H0610-E2704sEpsc/ L0000-k0 | 7.8 | H0610-G1dh/none-Hi-Kn010G3/L0000-K0 | 4.16E−09 | — |
| GCH054-E2704sEpsc/ L0011-k0 | 6.2 | GCH054-G1dh/none-Hi-Kn010G3/L0011-k0 | 5.25E−09 | K19T/Q43E/P52aG/K53E/ G55P/Q61E |
| GCH065-E2704sEpsc/ L0011-k0 | 6.4 | GCH065-G1dh/none-Hi-Kn010G3/L0011-k0 | 8.84E−10 | K19T/Q43E/P52aG/K53P/ G55P/Q61E |
| GCH094-E2704sEpsc/ L0011-k0 | 6.2 | GCH094-G1dh/none-Hi-Kn010G3/L0011-K0 | 4.54E−09 | K19T/I37V/P40A/Q43E/ I48M/P52aG/K53E/G55P/Q61E |

TABLE 11

| Antibody name | ECM binding ratio (standard = 1) |
|---|---|
| GPC3_ERY22_CE115 (rCE115H-E22Hh/rCE115L-k0/GL4-E22Hk/H0000-E22L) | 4.0 |
| GPC3_ERY27 (hCE115HA-E22Hh/L0000-k0/GL4-E22Hk/H0000-E22L) | 50.9 |
| CE115HA236-E22Hh/GLS3108-k0/GL4-E22Hk/H0610-E22L | 429.9 |
| CE115HA236-E22Hh/GLS3108-k0/GL4-E22Hk/H0000-E22L | 414.8 |
| CE115HA251-E22Hh/L0000-k0/GL4-E22Hk/H0000-E22L | 346.9 |
| CE115HA251-E22Hh/L0000-k0/GL4-E22Hk/H0610-E22L | 334.4 |
| TR01H002-E22Hh/GLS3108-k0/GL4-E22Hk/H0610-E22L | 301.1 |
| TR01H002-E22Hh/GLS3108-k0/GL4-E22Hk/H0000-E22L | 216.9 |
| TR01H015-E22Hh/L0000-k0/GL4-E22Hk/H0610-E22L | 185.7 |
| TR01H040-E2702GsKsc/H0610-E2704sEpsc/L0208-k0 | 50.4 |
| CE115HA122-E22Hh/L0000-k0/GL4-E22Hk/H0000-E22L | 47.0 |
| TR01H040-E2702GsKsc/H0610-E2704sEpsc/L0211-k0 | 15.5 |
| TR01H040-E2702GsKsc/H0610-E2704sEpsc/L0206-k0 | 15.4 |
| TR01H040-E2702GsKsc/H0610-E2704sEpsc/L0209-k0 | 7.4 |
| rCE115H-E22Hh/rCE115L-k0/GL4-E22Hk/H0610-E22L | 4.6 |
| TR01H040-E2702GsKsc/H0610-E2704sEpsc/L0204-k0 | 4.4 |
| TR01H067-E2702GsKsc/GCH054-E2704sEpsc/L0212-k0 | 3.3 |
| TR01H113-E2702GsKsc/GCH065-E2704sEpsc/L0011-k0 | 2.5 |
| TR01H082-E2702GsKsc/GCH065-E2704sEpsc/L0011-k0 | 1.7 |
| TR01H113-E2702GsKsc/GCH094-E2704sEpsc/L0011-k0 | 1.6 |
| rCE115H-E22Hh/rCE115L-k0/L0000-E22Hk/H0610-E22L | 1.4 |
| TR01H084-E2702GsKsc/GCH065-E2704sEpsc/L0011-k0 | 1.3 |
| TR01H084-E2702GsKsc/GCH094-E2704sEpsc/L0011-k0 | 1.2 |
| TR01H082-E2702GsKsc/GCH094-E2704sEpsc/L0201-k0 | 1.1 |
| TR01H040-E2702GsKsc/H0610-E2704sEpsc/L0000-k0 | 0.8 |
| TR01H040-E2702GsKsc/H0610-E2704sEpsc/L0201-k0 | 0.8 |
| TR01H040-E2702GsKsc/H0610-E2704sEpsc/L0203-k0 | 0.8 |
| TR01H082-E2702GsKsc/GCH094-E2704sEpsc/L0011-k0 | 0.7 |
| TR01H109-E2702GsKsc/GCH065-E2704sEpsc/L0011-k0 | 0.7 |
| TR01H067-E2702GsKsc/GCH054-E2704sEpsc/L0222-k0 | 0.6 |
| TR01H067-E2702GsKsc/GCH054-E2704sEpsc/L0201-k0 | 0.5 |
| TR01H109-E2702GsKsc/GCH094-E2704sEpsc/L0011-k0 | 0.4 |
| TR01H113-E2702sKsc/GCH065-E2704sEpsc/L0011-k0 | 0.3 |
| MRAH-G1d/MRAL-k0(standard) | 1 |

(3-5) Modifying the Binding Ability to the SuRe™ Ligand by Point Mutations

An example where the binding of an antibody to Protein A depends on its variable region sequence (VH3) is known (J Biomol Tech. 2011 July; 22(2):50-2). In the Protein A purification of the humanized anti-human CD3ε chain and anti-human GPC3 bispecific antibody, removal of the homomeric anti-CD3 antibody is important for suppressing non-specific reactions via CD3. Therefore, it is considered desirable to suppress the binding of the homomeric anti-CD3 antibody to Protein A. Presumably, the SuRe™ ligand will be used in commercial production, and thus point mutations for SuRe™ ligand binding were introduced into CDR2 of the humanized anti-CD3 antibody H-chain variants, TR01H082-E2702GsKsc and TR01H084-E2702GsKsc (SEQ ID NO:398 and 399), to prepare modified antibodies. The binding ability of these modified antibodies to the SuRe™ ligand was determined by the method described in Reference Example 5. As a result, amino acids at positions 19, 57, and 59 by Kabat numbering were found to contribute to the maintenance of the affinity for CD3ε and to have influence on the SuRe™ ligand-binding ability, and antibodies with a reduced SuRe™ ligand-binding ability in comparison to that of TR01H082-E2702GsKsc/L0011-k0 (SEQ ID NOs: 398 and 410) or TR01H084-E2702GsKsc/L0011-k0 (SEQ ID NOs: 399 and 410) were obtained (Table 12).

TABLE 12

| Antibody name | SuRe ™ binding (RU) | Mutation sites based on CE115HA000 |
|---|---|---|
| TR01H084-E2702GsKsc/L0011-k0 | 5065.8 | R16G/A52aD/N53Q/D72A/L78I/G98A/Y100G/A102I |
| TR01H082-E2702GsKsc/L0011-k0 | 4469.2 | V11L/A52aD/N53Q/G98A/Y100G |
| TR01H090-E2702GsKsc/L0011-k0 | 3606.3 | V11L/R16G/A52aD/N53Q/G98A/Y100G |
| TR01H093-E2702GsKsc/L0011-k0 | 2459.7 | V11L/A52aD/N53Q/K64Q/G98A/Y100G |
| TR01H094-E2702GsKsc/L0011-k0 | 2351.9 | V11L/A52aD/N53Q/K64S/G98A/Y100G |
| TR01H114-E2702GsKsc/L0011-k0 | 1485.5 | R16G/A52aD/N53Q/T57S/D72A/L78I/G98A/Y100G/A102I |
| TR01H092-E2702GsKsc/L0011-k0 | 1159.5 | V11L/A52aD/N53Q/K64A/G98A/Y100G |
| TR01H100-E2702GsKsc/L0011-k0 | 383.0 | V11L/A52aD/N53Q/T57S/G98A/Y100G |
| TR01H111-E2702GsKsc/L0011-k0 | 50.7 | R16G/R19K/A52aD/N53Q/D72A/L78I/G98A/Y100G/A102I |
| TR01H110-E2702GsKsc/L0011-k0 | 29.5 | R19K/A52aD/N53Q/G98A/Y100G |
| TR01H091-E2702GsKsc/L0011-k0 | 27.5 | V11L/R19K/A52aD/N53Q/G98A/Y100G |
| TR01H091-E2702GsKsc/L0011-k0 | 15.0 | V11L/R19K/A52aD/N53Q/G98A/Y100G |
| TR01H112-E2702GsKsc/L0011-k0 | 8.8 | R16G/A52aD/N53Q/T57Q/D72A/L78I/G98A/Y100G/A102I |
| TR01H113-E2702GsKsc/L0011-k0 | 7.0 | R16G/A52aD/N53Q/Y59V/D72A/L78I/G98A/Y100G/A102I |
| TR01H096-E2702GsKsc/L0011-k0 | 2.7 | V11L/A52aD/N53Q/T57G/G98A/Y100G |
| TR01H109-E2702GsKsc/L0011-k0 | 2.2 | V11L/A52aD/N53Q/Y59V/G98A/Y100G |
| TR01H098-E2702GsKsc/L0011-k0 | 1.6 | V11L/A52aD/N53Q/T57P/G98A/Y100G |

TABLE 12-continued

| Antibody name | SuRe ™ binding (RU) | Mutation sites based on CE115HA000 |
|---|---|---|
| TR01H107-E2702GsKsc/L0011-k0 | 1.4 | V11L/A52aD/N53Q/Y59Q/G98A/Y100G |
| TR01H103-E2702GsKsc/L0011-k0 | 1.4 | V11L/A52aD/N53Q/Y59G/G98A/Y100G |
| TR01H104-E2702GsKsc/L0011-k0 | 1.0 | V11L/A52aD/N53Q/Y59I/G98A/Y100G |
| TR01H105-E2702GsKsc/L0011-k0 | 0.8 | V11L/A52aD/N53Q/Y59L/G98A/Y100G |
| TR01H099-E2702GsKsc/L0011-k0 | 0.6 | V11L/A52aD/N53Q/T57Q/G98A/Y100G |
| TR01H102-E2702GsKsc/L0011-k0 | 0.5 | V11L/A52aD/N53Q/Y59F/G98A/Y100G |
| TR01H101-E2702GsKsc/L0011-k0 | 0.5 | V11L/A52aD/N53Q/T57V/G98A/Y100G |
| TR01H108-E2702GsKsc/L0011-k0 | 0.4 | V11L/A52aD/N53Q/Y59T/G98A/Y100G |
| TR01H097-E2702GsKsc/L0011-k0 | 0.1 | V11L/A52aD/N53Q/T57L/G98A/Y100G |
| TR01H106-E2702GsKsc/L0011-k0 | 0.0 | V11L/A52aD/N53Q/Y59P/G98A/Y100G |
| TR01H095-E2702GsKsc/L0011-k0 | −0.2 | V11L/A52aD/N53Q/T57F/G98A/Y100G |

(3-6) Production of Optimized Bispecific Antibodies by Combining Point Mutations that Lead to Improvement of Various Properties Optimized modified antibodies can be produced by combining the point mutations that lead to improvement of various properties as described in Examples 3-1 to 3-5. As examples of such modified antibodies, the antibodies described in Table 13 were produced, and they were subjected to the T-cell-dependent cellular cytotoxicity (TDCC) evaluation using methods similar to those of Example 1. The results are shown in FIGS. 4 to 9. As a result, optimized humanized anti-human CD3ε chain and anti-human GPC3 bispecific antibodies showing a T-cell-dependent cellular cytotoxicity equivalent to or greater than that of GPC3_ERY22_rCE115 prior to humanization were obtained.

TABLE 13

| Sample number in TDCC assay | Antibody name |
|---|---|
| 1 | GPC3_ERY22_CE115 (rCE115H-E22Hh/rCE115L-k0/GL4-E22Hk/H0000-E22L) |
| 2 | GPC3_ERY27 (hCE115HA-E22Hh/L0000-k0/GL4-E22Hk/H0000-E22L) |
| 3 | CE115HA251-E22Hh/L0000-k0/GL4-E22Hk/H0000-E22L |
| 4 | CE115HA236-E22Hh/GLS3108-k0/GL4-E22Hk/H0000-E22L |
| 5 | TR01H002-E22Hh/GLS3108-k0/GL4-E22Hk/H0000-E22L |
| 6 | CE115HA122-E22Hh/L0000-k0/GL4-E22Hk/H0000-E22L |
| 7 | rCE115H-E22Hh/rCE115L-k0/L0000-E22Hk/H0610-E22L |
| 8 | rCE115H-E22Hh/rCE115L-k0/GL4-E22Hk/H0610-E22L |
| 13 | TR01H040-E2702GsKsc/H0610-E2704sEpsc/L0000-k0 |
| 14 | TR01H040-E2702GsKsc/H0610-E2704sEpsc/L0201-k0 |
| 15 | TR01H040-E2702GsKsc/H0610-E2704sEpsc/L0203-k0 |
| 16 | TR01H040-E2702GsKsc/H0610-E2704sEpsc/L0204-k0 |
| 17 | TR01H040-E2702GsKsc/H0610-E2704sEpsc/L0206-k0 |
| 18 | TR01H040-E2702GsKsc/H0610-E2704sEpsc/L0208-k0 |
| 19 | TR01H040-E2702GsKsc/H0610-E2704sEpsc/L0209-k0 |
| 20 | TR01H040-E2702GsKsc/H0610-E2704sEpsc/L0211-k0 |
| 21 | rCE115H-E2702GsKsc/H0610-E2704sEpsc/L0000-k0 |
| 22 | TR01H061-E2702GsKsc/H0610-E2704sEpsc/L0000-k0 |
| 23 | TR01H068-E2702GsKsc/H0610-E2704sEpsc/L0000-k0 |
| 24 | TR01H071-E2702GsKsc/H0610-E2704sEpsc/L0000-k0 |
| 25 | TR01H067-E2702GsKsc/GCH054-E2704sEpsc/L0201-k0 |
| 26 | TR01H067-E2702GsKsc/GCH054-E2704sEpsc/L0212-k0 |
| 27 | TR01H067-E2702GsKsc/GCH054-E2704sEpsc/L0222-k0 |
| 28 | TR01H067-E2702GsKsc/GCH054-E2704sEpsc/L0000-k0 |
| 29 | TR01H082-E2702GsKsc/GCH094-E2704sEpsc/L0201-k0 |
| 30 | TR01H082-E2702GsKsc/GCH094-E2704sEpsc/L0011-k0 |
| 31 | TR01H084-E2702GsKsc/GCH094-E2704sEpsc/L0011-k0 |
| 32 | TR01H084-E2702GsKsc/GCH065-E2704sEpsc/L0011-k0 |
| 33 | TR01H082-E2702GsKsc/GCH065-E2704sEpsc/L0011-k0 |
| 34 | TR01H109-E2702GsKsc/GCH094-E2704sEpsc/L0011-k0 |
| 35 | TR01H109-E2702GsKsc/GCH065-E2704sEpsc/L0011-k0 |
| 36 | TR01H113-E2702GsKsc/GCH094-E2704sEpsc/L0011-k0 |
| 37 | TR01H113-E2702GsKsc/GCH065-E2704sEpsc/L0011-k0 |
| 38 | TR01H113-E2702GsKsc/GCH065-E2704sEpsc/L0011-k0 |

Examples 3-1 to 3-6 showed that the following amino acid residues, for example, are important for maintaining the properties of the optimized anti-human CD3ε chain and anti-human GPC3 bispecific antibodies showing a T-cell-dependent cellular cytotoxicity equivalent to or greater than that of GPC3_ERY22_rCE115 prior to humanization.

In anti-human CD3ε chain antibodies, the examples are Leu at position 11, Gly at position 16, Asp at position 52a, Gln at position 53, Ala at position 72, Ile at position 78, Ala at position 98, Gly at position 100, and Ile at position 102. In anti-human GPC3 antibodies, the examples are Thr at position 19, Glu at position 43, Gly at position 52a, Pro or Glu at position 53, Pro at position 55, and Glu at position 61. Furthermore, in common antibody L chains, the examples are Pro at position 25, Pro at position 27a, Pro at position 27b, Ile at position 33, Gln at position 34, Arg or Trp at position 56, and Tyr at position 89. (All positions are indicated by Kabat numbering).

Example 4

Evaluation of the In Vivo Efficacy

Some of the above-described antibodies were evaluated for their in vivo efficacy using tumor-bearing models.

Evaluation of the in vivo efficacy was carried out on representative antibodies from among those shown in Table 13, which have been confirmed to have cytotoxic activities from the in vitro assay described in Example 3-6. In the in vivo efficacy evaluation, any influence caused by differences in the microenvironment due to tumor aggregate formation on the evaluation results was taken into consideration. Therefore, two types of human cancer cell lines having different sensitivities to the antibody drug efficacy, i.e., PC-10 and NCI-H446, were used for the evaluation, even though the GPC3 expression levels of these cell lines were nearly equal. The cell lines were transplanted into the NOD scid mice, and the NOD scid mice with confirmed tumor formation were subjected to transplantation of T cells grown by in vitro culturing of human PBMCs. The mice (referred to as a T-cell injected model) were treated by administration of the optimized anti-human CD3ε chain and anti-human GPC3 bispecific antibodies.

More specifically, in drug efficacy tests of the optimized anti-human CD3ε chain and anti-human GPC3 bispecific antibodies using the PC-10 T-cell injected model, the tests below were performed. T cells were expansively cultured using PBMCs separated from blood collected from healthy volunteers and T cell activation/expansion kit/human (MACS Miltenyi biotec). The human cancer cell line PC-10 ($1 \times 10^7$ cells) was mixed with Matrigel™ Basement Membrane Matrix (BD), and transplanted to the inguinal subcutaneous region of NOD scid mice (CLEA Japan, female, 6W). The day of transplantation was defined as day 0. On the day before transplantation, the anti-asialo-GM1 antibody (Wako Pure Chemicals) was administered intraperitoneally to the mice at 0.2 mg/mouse. On days 13 to 15 after the transplantation, the mice were separated into groups according to their body weight and tumor size, and the anti-asialo-GM1 antibody was administered again intraperitoneally to the mice at 0.2 mg/mouse. On the following day, T cells obtained by the aforementioned expansive culturing were transplanted intraperitoneally at $3 \times 10^7$ cells/mouse. Four hours after T-cell transplantation, the optimized anti-human CD3ε chain and anti-human GPC3 bispecific antibodies were administered intravenously through the caudate vein at 1 mg/kg. The optimized anti-human CD3ε chain and anti-human GPC3 bispecific antibodies were administered only once.

As a result, anti-tumor activities were more clearly observed in the optimized anti-human CD3ε chain and anti-human GPC3 bispecific antibody-administered group than in the solvent-administered group (FIG. 10A and FIG. 10B).

Drug efficacy tests for the optimized anti-human CD3ε chain and anti-human GPC3 bispecific antibodies on the NCI-H446 T-cell injected model were performed by similar methods. The optimized anti-human CD3ε chain and anti-human GPC3 bispecific antibodies were administered once intravenously through the caudate vein at 5 mg/kg against NCI-H446.

As a result, anti-tumor activities were more clearly observed in the optimized anti-human CD3ε chain and anti-human GPC3bispecific antibody-administered group than in the solvent-administered group (FIG. 11A and FIG. 11B).

REFERENCE EXAMPLES

Reference Example 1

Production of Antibody Expression Vectors, and Antibody Expression and Purification Amino acid substitutions were introduced by methods known to those skilled in the art such as using the QuikChange Site-Directed Mutagenesis Kit (Stratagene), PCR, or the In-fusion Advantage PCR cloning kit (TAKARA) to construct expression vectors. Nucleotide sequences of the obtained expression vectors were determined by a method known to those skilled in the art. The produced plasmids were transiently introduced into cells of the human embryonic kidney cancer-derived cell line HEK293H (Invitrogen) or FreeStyle293 (Invitrogen) to express antibodies. From the obtained culture supernatants, antibodies were purified using the rProtein A Sepharose™ Fast Flow (GE Healthcare) by a method known to those skilled in the art. Absorbance at 280 nm of the purified antibody solutions was measured using a spectrophotometer, and antibody concentrations were calculated from the determined values using an absorption coefficient calculated by the PACE method (Protein Science 1995; 4: 2411-2423).

Reference Example 2

The ADCC Activity of Each Test Antibody Using Human Peripheral Blood Mononuclear Cells as the Effector Cell The ADCC activity of each test antibody was determined according to the method below.

Human peripheral blood mononuclear cells (hereinafter referred to as human PBMC) were used as the effector cell to measure the ADCC activity of each test antibody as below.

(1) Preparation of a Human PBMC Solution

From a healthy volunteer (adult male) of Chugai Pharmaceutical Co. Ltd., 50 mL of peripheral blood was collected using a syringe preloaded with 200 μL of a 1000 unit/mL heparin solution (Novo-Heparin Injection 5000 units, Novo Nordisk). The peripheral blood was diluted two-fold with PBS(−), divided into four aliquots, and added into a Leucosep lymphocyte separation tube (Greiner Bio-one) that had been loaded with 15 mL of Ficoll-Paque PLUS and subjected to centrifugation in advance. This separation tube containing aliquots of peripheral blood was centrifuged at 2150 rpm for ten minutes at room temperature, and then the mononuclear cell fraction was collected. The cells in each fraction were washed once with Dulbecco's Modified Eagle's Medium (SIGMA) containing 10% FBS (hereinafter referred to as 10% FBS/D-MEM) and then suspended in 10% FBS/D-MEM at a cell density of $5 \times 10^6$ cells/mL. After incubation in an incubator at 37° C. for one hour, the cells were washed once with 10% FBS/D-MEM, and the cells were suspended in 10% FBS/D-MEM to produce a cell density of $2 \times 10^5$ cells/mL. The cell suspension was subjected to the experiment below as the target cell.

(2) Chromium Release Assay (ADCC Activity)

The ADCC activity was evaluated from the specific chromium release rate according to the chromium release method. First, antibody solutions prepared at each concentration (0, 0.004, 0.04, 0.4, 4, and 40 μg/mL) were added to a 96-well U-bottomed plate at 50 μL per well. Next, the target cells were seeded at 50 μL per well ($1 \times 10^4$ cells/well), and this was allowed to stand at room temperature for 15 minutes. The human PBMC solution prepared in (1) was added at 100 μL per well ($5 \times 10^5$ cells/well), and the plate was left to stand in a 5% carbon dioxide gas incubator at 37° C. for four hours, followed by centrifugation. The radioactivity of 100 μL of culture supernatant in each well of the plate was measured using a gamma counter. The specific chromium release rate was determined based on the following equation:

$$\text{Specific chromium release rate } (\%) = (A-C) \times 100/(B-C)$$

In this equation, A represents the mean value of radioactivity (cpm) of 100 μL of culture supernatant in each well; B represents the mean value of radioactivity (cpm) of 100 μL of culture supernatant in the well where 100 μL of a 2% aqueous NP-40 solution (Nonidet P-40, Nacalai Tesque) and 50 μL of 10% FBS/D-MEM had been added to the target cells; and C represents the mean value of radioactivity (cpm)

of 100 μL of culture supernatant in the well where 150 μL of 10% FBS/D-MEM had been added to the target cells. The examinations were performed in triplicate and the mean values and standard deviations of the specific chromium release rates (%) in the above-mentioned examination reflecting the ADCC activity were calculated for each of the test antibodies.

Reference Example 3

Assessment of Tm of the Modified Antibodies by Differential Scanning Fluorimetry In this examination, the Tm (thermal denaturation temperature) value of the modified antibodies was assessed by differential scanning fluorimetry using Rotor-Gene Q (QIAGEN). It has been reported that this method has a favorable correlation with Tm assessment using a differential scanning calorimeter widely known as a method for evaluating thermal stability of antibodies (Journal of Pharmaceutical Science 2010; 4: 1707-1720).

The 5000×-concentrated SYPRO™ orange (Molecular Probes) was diluted with PBS (Sigma), and then admixed with the antibody solutions to prepare measurement samples. Twenty-μL aliquots of each sample were placed into measurement tubes, and the temperature was increased from 30° C. to 99° C. at a temperature elevation rate of 240° C./hr. Changes in fluorescence accompanying the temperature elevation were detected at 470 nm (excitation wavelength)/555 nm (fluorescence wavelength).

The data were analyzed using the Rotor-Gene Q Series software (QIAGEN) to calculate the temperature at which fluorescence transition was observed, and this temperature was defined as the Tm.

Reference Example 4

Assessment of the ECM-binding Ability

The assessment was carried out according to the method described in WO 2012093704. Specifically, BD Matrigel (BD Biosciences, #356237) was prepared at 2 mg/mL using TBS (Takara, #T903), and this was dispensed into a 96-well measurement plate (Meso Scale Discovery, #L15XB-3(High Bind)) at 5 μL per well and then allowed to stand overnight in a cool place. Then, 150 μL of an ECL blocking buffer (PBS containing 0.05% Tween20, 0.5% BSA, and 0.01% sodium azide) was dispensed into each well of the plate, and this was allowed to stand at room temperature for two hours or more.

A goat anti-human IgG(γ) (Invitrogen, #628400) was ruthenium-labeled with MSD SULFO-TAG NHS Ester (Meso Scale Discovery, #R91AN-2) by following the attached instructions. This was diluted in an ECL dilution buffer (PBS containing 0.01% Tween20, 0.1% BSA, and 0.01% sodium azide) to have a final concentration of 2 μg/mL. Furthermore, the standard antibody and the test antibodies were diluted in PBS-T (PBS containing 0.05% Tween 20 and 0.01% sodium azide) to have a final concentration of 3 μg/mL.

To a 96-well reaction plate (Thermo scientific, Nunc #145399), 10 μL of the ECL dilution buffer, 20 μL of the standard antibody and test antibody (3 μg/mL), and 30 μL of the ruthenium-labeled antibody (2 μg/mL) were added sequentially, and this was allowed to react for one hour at room temperature with stirring in the dark.

The ECL blocking buffer was removed from the 96-well measurement plate by tilting, 50 μL of the sample solution from the 96-well reaction plate was added, and this was allowed to stand in the dark at room temperature for one hour. This was followed by removal of the sample solution from the 96-well measurement plate by tilting, and immediately after addition of 150 μL of 2×T buffer (4×MSD Read Buffer T (Meso Scale Discovery) diluted two-fold using the ECL dilution buffer), ECL measurements were taken. SECTOR Imager 2400 (Meso Scale Discovery) was used for taking the measurements.

Analyses were carried out by dividing the fluorescence intensity of the test antibody by the fluorescence intensity of the standard antibody to calculate and compare the intensities by defining the value for the standard antibody to be 1.

Reference Example 5

Assessment of the SuRe™ Ligand-binding Ability

The ability to bind to the SuRe™ ligand was assessed by using Biacore™-T200 (GE Healthcare Japan). HBS-EP+ (GE Healthcare Japan) was used for the running buffer, and an amine coupling kit (GE Healthcare Japan) was used to covalently bind the Mab Select SuRe™ Ligand (GE Healthcare Japan) to the CM5 chip (carboxymethyl dextran-coated chip). The antibody used as the analyte was prepared at 5 μg/mL using HBS-EP+. Measurements were carried out by first injecting the 5-μg/mL antibody solution at a flow rate of 10 μL/min for 3 minutes, then switching to HBS-EP+, and measuring the response (RU) after allowing the flow to continue for 0.5 minutes. After completion of the measurements, the sensor chip was regenerated by washing with 10 mM Gly-HCl at pH 1.5. For the control flow cell, a similar experiment was performed without covalent bonding of the ligand to the chip, and the affinity for the SuRe™ ligand was analyzed by taking the difference between the responses (RU).

Sequences corresponding to the SEQ ID NOs mentioned herein are shown in the Table below.

TABLE 14

| SEQ ID NO: | Name |
|---|---|
| 1 | GPC3 nucleotide sequence (NM_001164617.1) |
| 2 | GPC3 amino acid sequence (NP_001158089.1) |
| 3 | Signal sequence |
| 4 | T cell receptor α-chain peptide (CAA26636.1) |
| 5 | T cell receptor β-chain peptide (C25777) |
| 6 | T cell receptor γ1-chain peptide (A26659) |
| 7 | T cell receptor γ2-chain peptide (AAB63312.1) |
| 8 | T cell receptor δ-chain peptide (AAA61033.1) |
| 9 | CD3 γ-chain nucleotide (NM_000073.2) |
| 10 | CD3 δ-chain nucleotide (NM_000732.4) |
| 11 | CD3 ε-chain nucleotide (NM_000733.3) |
| 12 | CD3 γ-chain peptide (NP_000064.1) |
| 13 | CD3 δ-chain peptide (NP_000723.1) |
| 14 | CD3 ε-chain peptide (NP_000724.1) |
| 15~22 | Peptide linker |
| 23 | Human Cγ1 |
| 24 | Human Cγ2 |
| 25 | Human Cγ3 |
| 26 | Human Cγ4 |
| 27 | FcγRI nucleotide (NM_000566.3) |
| 28 | FcγRI peptide (NP_000557.1) |
| 29 | FcγRIIA nucleotide (BC020823.1) |
| 30 | FcγRIIA peptide (AAH20823.1) |
| 31 | FcγRIIB nucleotide (BC146678.1) |
| 32 | FcγRIIB peptide (AAI46679.1) |
| 33 | FcγRIIIA nucleotide (BC033678.1) |
| 34 | FcγRIIIA peptide (AAH33678.1) |

TABLE 14-continued

| SEQ ID NO: | Name |
|---|---|
| 35 | FcγRIIIB nucleotide (BC128562.1) |
| 36 | FcγRIIIB peptide (AAI28563.1) |
| 37 | Fc region (addition of A to the N terminus of RefSeq accession number AAC82527.1) |
| 38 | Fc region (addition of A to the N terminus of RefSeq accession number AAB59393.1) |
| 39 | Fc region (addition of A to the N terminus of RefSeq accession number AAB59394.1) |
| 40 | H0000, GPC3 H-chain variable region |
| 41 | GL4, GPC3 L-chain variable region |
| 42 | rCE115H, CE115 H-chain variable region |
| 43 | rCE115L, CE115 L-chain variable region |
| 44 | G1dh |
| 45 | ERY22_Hk |
| 46 | ERY22_Hh |
| 47 | GL4-ERY22_Hk |
| 48 | H0000-ERY22_L |
| 49 | rCE115H-ERY22_Hh |
| 50 | rCE115L-k0 |
| 51 | hCE115HL (Heavy chain of humanized CE115) |
| 52 | hCE115HA (Heavy chain of humanized CE115) |
| 53 | L0000 (Light chain of humanized CE115) |
| 54 | H0000-ERY27_HK |
| 55 | hCE115HA-ERY27_HE |
| 56 | L0000-k0 |
| 57 | E22Hh |
| 58 | E22Hk |
| 59 | Hi-Kn010G3 |
| 60 | E2702GsKsc |
| 61 | E2704sEpsc |
| 62 | E2702sKsc |
| 63 | k0 |
| 64 | CE115HA177 |
| 65 | CE115HA178 |
| 66 | CE115HA179 |
| 67 | CE115HA180 |
| 68 | hCE115HAa |
| 69 | TR01H006 |
| 70 | TR01H007 |
| 71 | TR01H008 |
| 72 | TR01H009 |
| 73 | TR01H010 |
| 74 | TR01H011 |
| 75 | TR01H012 |
| 76 | TR01H013 |
| 77 | TR01H014 |
| 78 | TR01H015 |
| 79 | TR01H016 |
| 80 | TR01H017 |
| 81 | TR01H018 |
| 82 | TR01H019 |
| 83 | TR01H020 |
| 84 | TR01H021 |
| 85 | TR01H022 |
| 86 | TR01H023 |
| 87 | TR01H024 |
| 88 | TR01H025 |
| 89 | TR01H026 |
| 90 | TR01H027 |
| 91 | TR01H028 |
| 92 | TR01H029 |
| 93 | TR01H030 |
| 94 | TR01H031 |
| 95 | TR01H032 |
| 96 | TR01H033 |
| 97 | TR01H034 |
| 98 | TR01H035 |
| 99 | TR01H036 |
| 100 | TR01H037 |
| 101 | TR01H038 |
| 102 | TR01H039 |
| 103 | TR01H040 |
| 104 | TR01H041 |
| 105 | TR01H042 |
| 106 | TR01H043 |
| 107 | TR01H044 |
| 108 | TR01H045 |
| 109 | TR01H046 |
| 110 | TR01H047 |
| 111 | TR01H048 |
| 112 | TR01H049 |
| 113 | TR01H050 |
| 114 | TR01H051 |
| 115 | TR01H052 |
| 116 | TR01H053 |
| 117 | TR01H054 |
| 118 | TR01H055 |
| 119 | TR01H056 |
| 120 | TR01H057 |
| 121 | TR01H058 |
| 122 | TR01H061 |
| 123 | TR01H062 |
| 124 | TR01H063 |
| 125 | TR01H064 |
| 126 | TR01H065 |
| 127 | TR01H066 |
| 128 | TR01H067 |
| 129 | TR01H068 |
| 130 | TR01H069 |
| 131 | TR01H070 |
| 132 | TR01H071 |
| 133 | TR01H072 |
| 134 | TR01H073 |
| 135 | TR01H074 |
| 136 | TR01H075 |
| 137 | TR01H076 |
| 138 | TR01H077 |
| 139 | TR01H079 |
| 140 | TR01H080 |
| 141 | TR01H081 |
| 142 | TR01H082 |
| 143 | TR01H083 |
| 144 | TR01H084 |
| 145 | TR01H090 |
| 146 | TR01H091 |
| 147 | TR01H092 |
| 148 | TR01H093 |
| 149 | TR01H094 |
| 150 | TR01H095 |
| 151 | TR01H096 |
| 152 | TR01H097 |
| 153 | TR01H098 |
| 154 | TR01H099 |
| 155 | TR01H100 |
| 156 | TR01H101 |
| 157 | TR01H102 |
| 158 | TR01H103 |
| 159 | TR01H104 |
| 160 | TR01H105 |
| 161 | TR01H106 |
| 162 | TR01H107 |
| 163 | TR01H108 |
| 164 | TR01H109 |
| 165 | TR01H110 |
| 166 | TR01H111 |
| 167 | TR01H112 |
| 168 | TR01H113 |
| 169 | TR01H114 |
| 170 | GCH003 |
| 171 | GCH005 |
| 172 | GCH006 |
| 173 | GCH007 |
| 174 | GCH008 |
| 175 | GCH010 |
| 176 | GCH012 |
| 177 | GCH013 |
| 178 | GCH014 |
| 179 | GCH015 |
| 180 | GCH016 |
| 181 | GCH019 |
| 182 | GCH022 |
| 183 | GCH023 |
| 184 | GCH025 |
| 185 | GCH026 |
| 186 | GCH027 |
| 187 | GCH029 |

TABLE 14-continued

| SEQ ID NO: | Name |
|---|---|
| 188 | GCH032 |
| 189 | GCH034 |
| 190 | GCH035 |
| 191 | GCH039 |
| 192 | GCH040 |
| 193 | GCH042 |
| 194 | GCH043 |
| 195 | GCH045 |
| 196 | GCH053 |
| 197 | GCH054 |
| 198 | GCH055 |
| 199 | GCH056 |
| 200 | GCH057 |
| 201 | GCH059 |
| 202 | GCH060 |
| 203 | GCH061 |
| 204 | GCH062 |
| 205 | GCH064 |
| 206 | GCH065 |
| 207 | GCH066 |
| 208 | GCH067 |
| 209 | GCH068 |
| 210 | GCH073 |
| 211 | GCH094 |
| 212 | GCH098 |
| 213 | GCH099 |
| 214 | GCH100 |
| 215 | H0610 |
| 216 | L0000vk1 |
| 217 | L0002 |
| 218 | L0003 |
| 219 | L0006 |
| 220 | L0007 |
| 221 | L0008 |
| 222 | L0009 |
| 223 | L0011 |
| 224 | L0012 |
| 225 | L0013 |
| 226 | L0014 |
| 227 | L0015 |
| 228 | L0016 |
| 229 | L0032 |
| 230 | L0038 |
| 231 | L0039 |
| 232 | L0041 |
| 233 | L0042 |
| 234 | L0043 |
| 235 | L0044 |
| 236 | L0045 |
| 237 | L0046 |
| 238 | L0047 |
| 239 | L0062 |
| 240 | L0063 |
| 241 | L0064 |
| 242 | L0065 |
| 243 | L0066 |
| 244 | L0069 |
| 245 | L0075 |
| 246 | L0079 |
| 247 | L0082 |
| 248 | L0085 |
| 249 | L0089 |
| 250 | L0090 |
| 251 | L0091 |
| 252 | L0093 |
| 253 | L0104 |
| 254 | L0106 |
| 255 | L0107 |
| 256 | L0109 |
| 257 | L0113 |
| 258 | L0115 |
| 259 | L0117 |
| 260 | L0120 |
| 261 | L0122 |
| 262 | L0123 |
| 263 | L0124 |
| 264 | L0125 |
| 265 | L0126 |
| 266 | L0127 |
| 267 | L0129 |
| 268 | L0132 |
| 269 | L0134 |
| 270 | L0136 |
| 271 | L0137 |
| 272 | L0138 |
| 273 | L0139 |
| 274 | L0140 |
| 275 | L0141 |
| 276 | L0143 |
| 277 | L0144 |
| 278 | L0145 |
| 279 | L0147 |
| 280 | L0148 |
| 281 | L0149 |
| 282 | L0151 |
| 283 | L0152 |
| 284 | L0154 |
| 285 | L0155 |
| 286 | L0157 |
| 287 | L0160 |
| 288 | L0161 |
| 289 | L0163 |
| 290 | L0167 |
| 291 | L0168 |
| 292 | L0173 |
| 293 | L0175 |
| 294 | L0180 |
| 295 | L0181 |
| 296 | L0186 |
| 297 | L0187 |
| 298 | L0200 |
| 299 | L0201 |
| 300 | L0202 |
| 301 | L0203 |
| 302 | L0204 |
| 303 | L0205 |
| 304 | L0206 |
| 305 | L0207 |
| 306 | L0208 |
| 307 | L0209 |
| 308 | L0210 |
| 309 | L0211 |
| 310 | L0212 |
| 311 | L0213 |
| 312 | L0214 |
| 313 | L0215 |
| 314 | L0216 |
| 315 | L0217 |
| 316 | L0218 |
| 317 | L0219 |
| 318 | L0220 |
| 319 | L0222 |
| 320 | L0223 |
| 321 | L0224 |
| 322 | L0226 |
| 323 | L0227 |
| 324 | L0228 |
| 325 | L0229 |
| 326 | L0230 |
| 327 | L0231 |
| 328 | L0232 |
| 329 | L0233 |
| 330 | L0234 |
| 331 | L0235 |
| 332 | L0236 |
| 333 | L0237 |
| 334 | L0238 |
| 335 | L0239 |
| 336 | L0240 |
| 337 | L0241 |
| 338 | L0242 |
| 339 | L0243 |
| 340 | L0246 |
| 341 | L0247 |
| 342 | L0248 |
| 343 | L0249 |

TABLE 14-continued

| SEQ ID NO: | Name |
|---|---|
| 344 | L0250 |
| 345 | L0258 |
| 346 | L0259 |
| 347 | L0260 |
| 348 | L0261 |
| 349 | L0262 |
| 350 | L0263 |
| 351 | L0264 |
| 352 | L0265 |
| 353 | L0266 |
| 354 | L0267 |
| 355 | L0268 |
| 356 | L0269 |
| 357 | L0270 |
| 358 | L0271 |
| 359 | L0272 |
| 360 | TR01L001 |
| 361 | TR01L002 |
| 362 | TR01L003 |
| 363 | TR01L004 |
| 364 | TR01L005 |
| 365 | TR01L006 |
| 366 | TR01L007 |
| 367 | TR01L008 |
| 368 | TR01L009 |
| 369 | TR01L010 |
| 370 | TR01L011 |
| 371 | TR01L012 |
| 372 | TR01L013 |
| 373 | TR01L015 |
| 374 | TR01L016 |
| 375 | TR01L017 |
| 376 | TR01L018 |
| 377 | TR01L019 |
| 378 | TR01L020 |
| 379 | TR01L023 |
| 380 | TR01L024 |
| 381 | CE115HA122-E22Hh |
| 382 | CE115HA236-E22Hh |
| 383 | CE115HA251-E22Hh |
| 384 | GCH054-E2704sEpsc |
| 385 | GCH065-E2704sEpsc |
| 386 | GCH094-E2704sEpsc |
| 387 | H0610-E2704sEpsc |
| 388 | hCE115HA-E22Hh |
| 389 | rCE115H-E22Hh |
| 390 | rCE115H-E2702GsKsc |
| 391 | TR01H002-E22Hh |
| 392 | TR01H015-E22Hh |
| 393 | TR01H040-E2702GsKsc |
| 394 | TR01H061-E2702GsKsc |
| 395 | TR01H067-E2702GsKsc |
| 396 | TR01H068-E2702GsKsc |
| 397 | TR01H071-E2702GsKsc |
| 398 | TR01H082-E2702GsKsc |
| 399 | TR01H084-E2702GsKsc |
| 400 | TR01H109-E2702GsKsc |
| 401 | TR01H113-E2702GsKsc |
| 402 | TR01H113-E2702sKsc |
| 403 | GL4-E22Hk |
| 404 | L0000-E22Hk |
| 405 | H0000-E22L |
| 406 | H0610-E22L |
| 407 | rCE115L-k0 |
| 408 | GLS3108-k0 |
| 409 | L0000-k0 |
| 410 | L0011-k0 |
| 411 | L0201-k0 |
| 412 | L0203-k0 |
| 413 | L0204-k0 |
| 414 | L0206-k0 |
| 415 | L0208-k0 |
| 416 | L0209-k0 |
| 417 | L0211-k0 |
| 418 | L0212-k0 |
| 419 | L0222-k0 |
| 420 | TR01H001 |
| 421 | TR01H002 |
| 422 | TR01H003 |
| 423 | TR01H004 |
| 424 | rCE115H |
| 425 | CE115HA121 |
| 426 | CE115HA122 |
| 427 | CE115HA124 |
| 428 | CE115HA192 |
| 429 | CE115HA236 |
| 430 | CE115HA251 |
| 431 | CE115HA252 |
| 432 | E22L |

INDUSTRIAL APPLICABILITY

The present invention provides novel multispecific antigen-binding molecules that maintain the strong anti-tumor activity possessed by BiTE and the excellent safety property of not inducing a cytokine storm or such independently from cancer antigen, and also have long half-lives in blood. Cytotoxicity-inducing agents that comprise an antigen-binding molecule of the present invention as an active ingredient can target glypican 3-expressing cells and tumor tissues containing these cells and induce cell injury. Administration of a multispecific antigen-binding molecule of the present invention to patients makes it possible to have a desirable treatment which not only has a high level of safety but also a reduced physical burden, and is highly convenient.

SEQUENCE LISTING (432 sequences)

SEQ ID NO: 1 - DNA, 2398 bp, Homo sapiens
agccccgccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactgaaactgagaagaaaatatggcacttcaaatatcctatcttcttcctgtgtatagggctagacttacagattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaaaaaaaaaaaa

SEQ ID NO: 2 - protein, 603 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTETEKKIWHFKYPIFFLCIGLDLQIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 3 - protein, 19 aa, Artificial
  An artificially generated sequence
MGWSCIILFLVATATGVHS

SEQ ID NO: 4 - protein, 141 aa, Homo sapiens
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5 - protein, 179 aa, Homo sapiens
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 6 - protein, 173 aa, Homo sapiens
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 7 - protein, 204 aa, Homo sapiens
KQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKDSYSKDANDVTTVDPKYNYSKDANDVITMDPKDNWSKDANDTLLLQLTNTSAYYMYLLLLLKSVVYFAIITCCLLGRTAFCCNGEKS

SEQ ID NO: 8 - protein, 177 aa, Homo sapiens
PSYTGGYADKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 9 - DNA, 1311 bp, Homo sapiens
agtctagctgctgcacaggctggctggctggctggctgctaagggctgctccacgcttttgccggaggacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 10 - DNA, 771 bp, Homo sapiens
agagaagcagacatcttctagttcctcccccactctcctctttccggtacctgtgagtcagctaggggagggcagctctcacccaggctgatagttcggtgacctggctttatctactggatgagttccgctgggagatggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaatatatcctctttcactcagaaaaaaaaaaaaaaaaaaaaaaaaaaaaaa

SEQ ID NO: 11 - DNA, 1534 bp, Homo sapiens
tattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagaaaaaaaaaaaaaaaaaaaaaa

SEQ ID NO: 12 - protein, 182 aa, Homo sapiens
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 13 - protein, 171 aa, Homo sapiens
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 14 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 15 - protein, 4 aa, Artificial
  An artificially generated sequence
GGGS

SEQ ID NO: 16 - protein, 4 aa, Artificial
  An artificially generated sequence
SGGG

SEQ ID NO: 17 - protein, 5 aa, Artificial
  An artificially generated sequence
GGGGS

SEQ ID NO: 18 - protein, 5 aa, Artificial
  An artificially generated sequence
SGGGG

SEQ ID NO: 19 - protein, 6 aa, Artificial
  An artificially generated sequence
GGGGGS

SEQ ID NO: 20 - protein, 6 aa, Artificial
  An artificially generated sequence
SGGGGG

SEQ ID NO: 21 - protein, 7 aa, Artificial
  An artificially generated sequence
GGGGGGS

SEQ ID NO: 22 - protein, 7 aa, Artificial
  An artificially generated sequence
SGGGGGG

SEQ ID NO: 23 - protein, 330 aa, Homo sapiens [sequence omitted]

SEQ ID NO: 24 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 25 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 26 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 27 - DNA, 2268 bp, Homo sapiens
aatatcttgcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgcactgtgaggtgctccatctgcctgggagcagctctacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggctggctactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcatgggaaagcatcgctacacatcagcaggaatatctgtcactgtgaaagagctatttccagctccagtgctgaatgcatctgtgacatccccactcctggaggggaatctggtcaccctgagctgtgaaacaaagttgctcttgcagaggcctggtttgcagctttacttctccttctacatgggcagcaagaccctgcgaggcaggaacacatcctctgaataccaaatactaactgctagaagagaagactctgggttatactggtgcgaggctgccacagaggatggaaatgtccttaagcgcagccctgagttggagcttcaagtgcttggcctccagttaccaactcctgtctggtttcatgtccttttctatctggcagtgggaataatgtttttagtgaacactgttctctgggtgacaatacgtaaagaactgaaaagaaagaaaaagtgggatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgcccacttgctccccgtgagcactgcgtacaaacatccaaaagttcaacaacaccagaactgtgtgtctcatggtatgtaactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagccaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctgtttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacatagctgaggtaaaaactgaactatgtaaatgactctactaaaagtttagggaaaaaaaacaggaggagtatgacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 28 - protein, 374 aa, Homo sapiens
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 29 - DNA, 1396 bp, Homo sapiens
gggatgactatggagacccaaatgtctcagaatgtatgtcccagaaacctgtggctgcttcaaccattgacagttttgctgctgctggcttctgcagacagtcaagctgctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatgggggtcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgactaaaaaaaaaaaaaaaaaaaaaaaaaaaaaa

SEQ ID NO: 30 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGVIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 31 - DNA, 1497 bp, Homo sapiens
tgtgactgctgtgctctgggcgccagctcgctccagggagtgatgggaatcctgtcattcttacctgtccttgccactgagagtgactgggctgactgcaagtccccccagccttggggtcatatgcttctgtggacagctgtgctattcctggctcctgttgctgggacacctgcagctcccccaaaggctgtgctgaaactcgagccccagtggatcaacgtgctccaggaggactctgtgactctgacatgccgggggactcacagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttctgagtggctggtgctccagacccctcacctggagttccaggagggagaaaccatcgtgctgaggtgccacagctggaaggacaagcctctggtcaaggtcacattcttccagaatggaaaatccaagaaattttcccgttcggatcccaacttctccatcccacaagcaaaccacagtcacagtggtgattaccactgcacaggaaacataggctacacgctgtactcatccaagcctgtgaccatcactgtccaagctcccagctcttcaccgatggggatcattgtggctgtggtcactgggattgctgtagcggccattgttgctgctgtagtggccttgatctactgcaggaaaaagcggatttcagccaatcccactaatcctgatgaggctgacaaagttggggctgagaacacaatcacctattcacttctcatgcacccggatgctctggaagagcctgatgaccagaaccgtatttagtctccattgtcttgcattgggatttgagaagaaaatcagagagggaagatctggtatttcctggcctaaattccccttggggaggacagggagatgctgcagttccaaaagagaaggtttcttccagagtcatctacctgagtcctgaagctccctgtcctgaaagccacagacaatatggtcccaaataaccgactgcaccttctgtgcttcagctcttcttgacatcaaggctcttccgttccacatccacacagccaatccaattaatcaaaccactgttattaacagataatagcaacttgggaaatgcttatgttacaggttacgtgagaacaatcatgtaaatctatatgatttcagaaatgttaaaatagactaacctctaccagcacattaaaagtgattgtttctgggtgataaaattattgatgatttttattttctttatttttctataaagatcatatattacttttataataaaacattataaaaacaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 32 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 33 - DNA, 2137 bp, Homo sapiens
cttgtccactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagagcctcatctcaagccaggcctcgagctacttcattgacgctgccacagttgacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttgtcagtgtcaaccatctcatcattctttccacctgggtaccaagtctctttctgcttggtgatggtactcctttttgcagtggacacaggactatatttctctgtgaagacaaacattcgaagctcaacaagagactggaaggaccataaatttaaatggagaaaggaccctcaagacaaatgacccccatcccatgggggtaataagagcagtagcagcagcatctctgaacatttctctggatttgcaaccccatcatcctcaggcctctctacaagcagcaggaaacatagaactcagagccagatcccttatccaactctcgacttttccttggtctccagtggaagggaaaagcccatgatcttcaagcagggaagccccagtgagtagctgcattcctagaaattgaagtttcagagctacacaaacactttttctgtcccaaccgttccctcacagcaaagcaacaatacaggctagggatggtaatcctttaaacatacaaaaattgctcgtgttataaattacccagtttagaggggaaaaaaaaacaattattcctaaataaatggataagtagaattaatggttgaggcaggaccatacagagtgtgggaactgctggggatctagggaattcagtgggaccaatgaaagcatggctgagaaatagcaggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatctccaagtatataacgatgagtcctcttaatgctaggagtagaaaatggtcctaggaaggggactgaggattgcggtggggggtggggtggaaaagaaagtacagaacaaaccctgtgtcactgtcccaagttgctaagtgaacagaactatctcagcatcagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatatctaattcctgtgtagctttgttcattgcatttattaaacaaatgttgtataaccaatactaaatgtactactgagcttcgctgagttaagttatgaaactttcaaatccttcatcatgtcagttccaatgaggtggggatggagaagacaattgttgcttatgaaagaaagctttagctgtctctgttttgtaagctttaagcgcaacatttcttggttccaataaagcattttacaagatcttgcatgctactcttagatagaagatgggaaaaccatggtaataaaatatgaatgataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 34 - protein, 254 aa, Homo sapiens [sequence omitted]

SEQ ID NO: 35 - DNA, 820 bp, Homo sapiens
cactccagtgtggcatcatgtggcagctgctcctcccaactgctctgctacttctagtttcagctggcatgcggactgaagatctcccaaaggctgtggtgttcctggagcctcaatggtacagcgtgcttgagaaggacagtgtgactctgaagtgccagggagcctactcccctgaggacaattccacacagtggtttcacaatgagagcctcatctcaagccaggcctcgagctacttcattgacgctgccacagtcaacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcag

SEQ ID NO: 36 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 37 - protein, 330 aa, Homo sapiens [sequence omitted]

SEQ ID NO: 38 - protein, 326 aa, Homo sapiens; identical to SEQ ID NO: 24

SEQ ID NO: 39 - protein, 327 aa, Homo sapiens; identical to SEQ ID NO: 26

SEQ ID NO: 40 - protein, 115 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSS

SEQ ID NO: 41 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIK

SEQ ID NO: 42 - protein, 122 aa, Rattus norvegicus
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSS

SEQ ID NO: 43 - protein, 112 aa, Rattus norvegicus
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELK

SEQ ID NO: 44 - protein, 328 aa, Artificial
  An artificially generated sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 45 - protein, 338 aa, Artificial
  An artificially generated sequence
SSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 46 - protein, 336 aa, Artificial
  An artificially generated sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 47 - protein, 450 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCSQNTHVPPTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 48 - protein, 222 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 49 - protein, 458 aa, Artificial
  An artificially generated sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 50 - protein, 219 aa, Artificial
  An artificially generated sequence
DVVMTQTPVSMSVSLGGQVSISCRSSQSLVHNNGNTYVSWYIQKPSQSPQLLIYKVSNRFSGISDRFSGSGSGTDFTLKISRVEPDDLGVYYCGQGTQDPYTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCARVHYGAYYGVDAWGQGTTVTVSS

SEQ ID NO: 52 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSS

SEQ ID NO: 53 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 54 - protein, 448 aa, Artificial
  An artificially generated sequence
QVQLVQSGAEVKKPGASVKVSCKASGYTFTDYEMHWIRQPPGQGLEWIGAIDPKTGDTAYSQKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVMHEALHNRYTQKSLSLSLHHHHHHHH

SEQ ID NO: 55 - protein, 455 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQESLSLSLDYKDDDDK

SEQ ID NO: 56 - protein, 219 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 336 aa, Artificial; identical to SEQ ID NO: 46
  An artificially generated sequence

SEQ ID NO: 58 - protein, 338 aa, Artificial; identical to SEQ ID NO: 45
  An artificially generated sequence

SEQ ID NO: 59 - protein, 230 aa, Artificial
  An artificially generated sequence
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNRYTQKSLSLSP

SEQ ID NO: 60 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 61 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 62 - protein, 325 aa, Artificial
  An artificially generated sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 63 - protein, 107 aa, Artificial [sequence omitted]

SEQ ID NO: 64 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGAYYGVDAWGQGTTVTVSS

SEQ ID NO: 65 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRDDSKNSIYLQMNSLKTEDTAVYYCRYVHYGAYYGVQAWGQGTTVTVSS

SEQ ID NO: 66 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGAYYGVQAWGQGTTVTVSS

SEQ ID NO: 67 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRADSKNSLYLQMNSLKTEDTAVYYCRYVHYGAYYGVQAWGQGTTVTVSS

SEQ ID NO: 68 - protein, 122 aa, Artificial
  An artificially generated sequence
QVQLVESGGGVVQPGGSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSS

SEQ ID NO: 69 - protein, 122 aa, Artificial
  An artificially generated sequence
QVQLVESGGGLVQPGRSLRLSCAASGFTFSNAWMHWVRQAPGKGLEWVAQIKAKSQNYATYYAESVKGRFTISRADSKNSIYLQMNSLKTEDTAVYYCRYVHYGAYYGVDIWGQGTTVTVSS

SEQ ID NO: 70 - protein, 122 aa, Artificial
  An artificially generated sequence
QVQLVESGGGLVQPGRSLRLSCAASGFTFSNAWMHWVRQAPGKGLEWVAQIKSKSNNYATYYAESVKGRFTISRADSKNSIYLQMNSLKTEDTAVYYCRYVHYGAYYGVDIWGQGTTVTVSS

SEQ ID NO: 71 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYGAYYGVDIWGQGTTVTVSS

SEQ ID NO: 72 - protein, 122 aa, Artificial
  An artificially generated sequence
QVQLVESGGGLVQPGRSLRLSCAASGFTFSNAWMHWVRQAPGKGLEWVAQIKAKSNNYATYYAPSVKGRFTISRADSKNSIYLQMNSLKTEDTAVYYCRYVHYGAYYGVDIWGQGTTVTVSS

SEQ ID NO: 73 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYSAYYGVDIWGQGTTVTVSS

SEQ ID NO: 74 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYGASYGVDIWGQGTTVTVSS

SEQ ID NO: 75 - protein, 122 aa, Artificial
  An artificially generated sequence
QVQLVESGGGLVQPGRSLRLSCAASGFTFSNAWMHWVRQAPGKGLEWVAQIKAKSNNYATYYAESVKGRFTISRADSKNSIYLQMNSLKTEDTAVYYCRYVHYYYSYGVDIWGQGTTVTVSS

SEQ ID NO: 76 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYGAYYGVDIWGQGTTVTVSS

SEQ ID NO: 77 - protein, 122 aa, Artificial
  An artificially generated sequence
QVQLVESGGGLVQPGRSLRLSCAASGFTFSNAWMHWVRQAPGKGLEWVAQIKGKSNNYATYYAPSVKGRFTISRADSKNSIYLQMNSLKTEDTAVYYCRYVHYGAYYGVDIWGQGTTVTVSS

SEQ ID NO: 78 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 79 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSYSYGVDIWGQGTTVTVSS

SEQ ID NO: 80 - protein, 122 aa, Artificial
  An artificially generated sequence
QVQLVESGGGLVQPGGSLRLSCAASGFTFSNAWMHWVRQAPGKGLEWVAQIKAKSNNYATYYAESVKGRFTISRADSKNSIYLQMNSLKTEDTAVYYCRYVHYGAYYGVDIWGQGTTVTVSS

SEQ ID NO: 81 - protein, 122 aa, Artificial
  An artificially generated sequence
QVQLVESGGGLVQPGGSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 82 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDIWGQGTTVTVSS

SEQ ID NO: 83 - protein, 122 aa, Artificial
  An artificially generated sequence
QVQLVESGGGLVQPGRSLRLSCAASGFTFSNAWMHWVRQAPGKGLEWVAQIKGKSNNYATYYAPSVKGRFTISRADSKNSIYLQMNSLKTEDTAVYYCRYVHYSASYGVDIWGQGTTVTVSS

SEQ ID NO: 84 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDAWGQGTTVTVSS

SEQ ID NO: 85 - protein, 122 aa, Artificial
  An artificially generated sequence
QVQLVESGGGLVQPGGSLRLSCAASGFTFSNAWMHWVRQAPGKGLEWVAQIKGKSQNYATYYAPSVKGRFTISRADSKNSIYLQMNSLKTEDTAVYYCRYVHYSASYGVDIWGQGTTVTVSS

SEQ ID NO: 86 - protein, 122 aa, Artificial
  An artificially generated sequence
QVQLVESGGGLVQPGGSLRLSCAASGFTFSNAWMHWVRQAPGKGLEWVAQIKGKSQNYATYYAESVKGRFTISRADSKNSIYLQMNSLKTEDTAVYYCRYVHYSASYGVDIWGQGTTVTVSS

SEQ ID NO: 87 - protein, 122 aa, Artificial
  An artificially generated sequence
QVQLVESGGGLVQPGGSLRLSCAASGFTFSNAWMHWVRQAPGKGLEWVAQIKGKSQNYATYYAESVKGRFTISRADSKNSIYLQMNSLKTEDTAVYYCRYVHYSASYGVDAWGQGTTVTVSS

SEQ ID NO: 88 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 89 - protein, 122 aa, Artificial
  An artificially generated sequence
QVQLVESGGGLVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 90 - protein, 122 aa, Artificial
  An artificially generated sequence
QVQLVESGGGLVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDAWGQGTTVTVSS

SEQ ID NO: 91 - protein, 122 aa, Artificial
  An artificially generated sequence
QVQLVESGGGVVQPGGSLRLSCAASGFTFSNAWMHWVRQAPGKGLEWVAQIKSKSQNYATYYAESVKGRFTISRADSKNSIYLQMNSLKTEDTAVYYCRYVHYSASYGVDIWGQGTTVTVSS

SEQ ID NO: 92 - protein, 122 aa, Artificial
  An artificially generated sequence
QVQLVESGGGLVQPGRSLRLSCSASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 93 - protein, 122 aa, Artificial
  An artificially generated sequence
QVQLVESGGGVVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 94 - protein, 122 aa, Artificial
  An artificially generated sequence
QVQLVESGGGVVQPGGSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 95 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDAWGQGTTVTVSS

SEQ ID NO: 96 - protein, 122 aa, Artificial
  An artificially generated sequence
QVQLVESGGGLVQPGRSLRLSCAASGFTFSNAWMHWVRQAPGKGLEWVAQIKSKSQNYATYYAESVKGRFTISRADSKNSIYLQMNSLKTEDTAVYYCRYVHYSASYGVDYWGQGTTVTVSS

SEQ ID NO: 97 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDAWGQGTTVTVSS

SEQ ID NO: 98 - protein, 122 aa, Artificial
  An artificially generated sequence
QVQLVESGGGLVQPGRSLRLSCAASGFTFSNAWMHWVRQAPGKGLEWVAQIKGKSQNYATYYAESVKGRFTISRADSKNSIYLQMNSLKTEDTAVYYCRYVHYSASYGVDYWGQGTTVTVSS

SEQ ID NO: 99 - protein, 122 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDYWGQGTTVTVSS

SEQ ID NO: 100 - protein, 122 aa, Artificial
  An artificially generated sequence
QVQLVESGGGLVQPGRSLRLSCAASGFTFSNAWMPWVRQAPGKGLEWVAQIKGKSNNYATYYAESVKGRFTISRADSKNSIYLQMNSLKTEDTAVYYCRYVHYSASYGVDIWGQGTTVTVSS

SEQ ID NO: 101 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYSASYGVDIWGQGTTVTVSS

SEQ ID NO: 102 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDIWGQGTTVTVSS

SEQ ID NO: 103 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 104 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDYWGQGTTVTVSS

SEQ ID NO: 105 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 106 - protein, 122 aa, Artificial
  An artificially generated sequence
QVQLVESGGGLVQPGRSLRLSCSASGFTFSNAWMHWVRQAPGKGLEWVAQIKDKSNNYATYYAESVKGRFTISRADSKNSIYLQMNSLKTEDTAVYYCRYVHYSASYGVDIWGQGTTVTVSS

SEQ ID NO: 107 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDIWGQGTTVTVSS

SEQ ID NO: 108 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSS

SEQ ID NO: 109 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYSASYGVDYWGQGTTVTVSS

SEQ ID NO: 110 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRDDSKNSIYLQMNSLKTEDTAVYYCRYVHYSASYGVDIWGQGTTVTVSS

SEQ ID NO: 111 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDIWGQGTTVTVSS

SEQ ID NO: 112 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDAWGQGTTVTVSS

SEQ ID NO: 113 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYSASYGVDYWGQGTTVTVSS

SEQ ID NO: 114 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSLYLQMNSLKTEDTAVYYCRYVHYSASYGVDIWGQGTTVTVSS

SEQ ID NO: 115 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDIWGQGTTVTVSS

SEQ ID NO: 116 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDAWGQGTTVTVSS

SEQ ID NO: 117 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYSASYGVDYWGQGTTVTVSS

SEQ ID NO: 118 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRDDSKNSLYLQMNSLKTEDTAVYYCRYVHYSASYGVDIWGQGTTVTVSS

SEQ ID NO: 119 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDIWGQGTTVTVSS

SEQ ID NO: 120 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDAWGQGTTVTVSS

SEQ ID NO: 121 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYSASYGVDYWGQGTTVTVSS

SEQ ID NO: 122 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSS

SEQ ID NO: 123 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 124 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 125 - protein, 122 aa, Artificial
  An artificially generated sequence
QVQLVESGGGLVQPGRSLRLSCSASGFTFSNAWMHWVRQAPGKGLEWVAQIKDKSQNYATYYAESVKGRFTISRADSKNSIYLQMNSLKTEDTAVYYCRYVHYAASYGVDAWGQGTTVTVSS

SEQ ID NO: 126 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSIYLQMNSLKTEDTAVYYCRYVHYAASYGVDAWGQGTTVTVSS

SEQ ID NO: 127 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSLYLQMNSLKTEDTAVYYCRYVHYAASYGVDAWGQGTTVTVSS

SEQ ID NO: 128 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSS

SEQ ID NO: 129 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSS

SEQ ID NO: 130 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDIWGQGTTVTVSS

SEQ ID NO: 131 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDYWGQGTTVTVSS

SEQ ID NO: 132 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAASYGVDIWGQGTTVTVSS

SEQ ID NO: 133 - protein, 122 aa, Artificial; identical to SEQ ID NO: 122
  An artificially generated sequence

SEQ ID NO: 134 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDIWGQGTTVTVSS

SEQ ID NO: 135 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSS

SEQ ID NO: 136 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDYWGQGTTVTVSS

SEQ ID NO: 137 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAASYGVDYWGQGTTVTVSS

SEQ ID NO: 138 - protein, 124 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAAEMVRDDIWGQGTTVTVSS

SEQ ID NO: 139 - protein, 128 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAAEMVRDSYGVDIWGQGTTVTVSS

SEQ ID NO: 140 - protein, 128 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAVRRRLSSYGVDIWGQGTTVTVSS

SEQ ID NO: 141 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 142 - protein, 122 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 143 - protein, 122 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAAGYGVDIWGQGTTVTVSS

SEQ ID NO: 144 - protein, 122 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 145 - protein, 122 aa, Artificial
  An artificially generated sequence
QVQLVESGGGLVQPGGSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 146 - protein, 122 aa, Artificial
  An artificially generated sequence
QVQLVESGGGLVQPGRSLKLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 147 - protein, 122 aa, Artificial
  An artificially generated sequence
QVQLVESGGGLVQPGRSLRLSCAASGFTFSNAWMHWVRQAPGKGLEWVAQIKDKSQNYATYYAESVAGRFTISRDDSKNSLYLQMNSLKTEDTAVYYCRYVHYAAGYGVDAWGQGTTVTVSS

SEQ ID NO: 148 - protein, 122 aa, Artificial
  An artificially generated sequence
QVQLVESGGGLVQPGRSLRLSCAASGFTFSNAWMHWVRQAPGKGLEWVAQIKDKSQNYATYYAESVQGRFTISRDDSKNSLYLQMNSLKTEDTAVYYCRYVHYAAGYGVDAWGQGTTVTVSS

SEQ ID NO: 149 - protein, 122 aa, Artificial
  An artificially generated sequence
QVQLVESGGGLVQPGRSLRLSCAASGFTFSNAWMHWVRQAPGKGLEWVAQIKDKSQNYATYYAESVSGRFTISRDDSKNSLYLQMNSLKTEDTAVYYCRYVHYAAGYGVDAWGQGTTVTVSS

SEQ ID NO: 150 - protein, 122 aa, Artificial
  An artificially generated sequence
QVQLVESGGGLVQPGRSLRLSCAASGFTFSNAWMHWVRQAPGKGLEWVAQIKDKSQNYAFYYAESVKGRFTISRDDSKNSLYLQMNSLKTEDTAVYYCRYVHYAAGYGVDAWGQGTTVTVSS

SEQ ID NO: 151 - protein, 122 aa, Artificial
  An artificially generated sequence
QVQLVESGGGLVQPGRSLRLSCAASGFTFSNAWMHWVRQAPGKGLEWVAQIKDKSQNYAGYYAESVKGRFTISRDDSKNSLYLQMNSLKTEDTAVYYCRYVHYAAGYGVDAWGQGTTVTVSS

SEQ ID NO: 152 - protein, 122 aa, Artificial
  An artificially generated sequence
QVQLVESGGGLVQPGRSLRLSCAASGFTFSNAWMHWVRQAPGKGLEWVAQIKDKSQNYALYYAESVKGRFTISRDDSKNSLYLQMNSLKTEDTAVYYCRYVHYAAGYGVDAWGQGTTVTVSS

SEQ ID NO: 153 - protein, 122 aa, Artificial
  An artificially generated sequence
QVQLVESGGGLVQPGRSLRLSCAASGFTFSNAWMHWVRQAPGKGLEWVAQIKDKSQNYAPYYAESVKGRFTISRDDSKNSLYLQMNSLKTEDTAVYYCRYVHYAAGYGVDAWGQGTTVTVSS

SEQ ID NO: 154 - protein, 122 aa, Artificial
  An artificially generated sequence
QVQLVESGGGLVQPGRSLRLSCAASGFTFSNAWMHWVRQAPGKGLEWVAQIKDKSQNYAQYYAESVKGRFTISRDDSKNSLYLQMNSLKTEDTAVYYCRYVHYAAGYGVDAWGQGTTVTVSS

SEQ ID NO: 155 - protein, 122 aa, Artificial
  An artificially generated sequence
QVQLVESGGGLVQPGRSLRLSCAASGFTFSNAWMHWVRQAPGKGLEWVAQIKDKSQNYASYYAESVKGRFTISRDDSKNSLYLQMNSLKTEDTAVYYCRYVHYAAGYGVDAWGQGTTVTVSS

SEQ ID NO: 156 - protein, 122 aa, Artificial
  An artificially generated sequence
QVQLVESGGGLVQPGRSLRLSCAASGFTFSNAWMHWVRQAPGKGLEWVAQIKDKSQNYAVYYAESVKGRFTISRDDSKNSLYLQMNSLKTEDTAVYYCRYVHYAAGYGVDAWGQGTTVTVSS

SEQ ID NO: 157 - protein, 122 aa, Artificial
  An artificially generated sequence
QVQLVESGGGLVQPGRSLRLSCAASGFTFSNAWMHWVRQAPGKGLEWVAQIKDKSQNYATYFAESVKGRFTISRDDSKNSLYLQMNSLKTEDTAVYYCRYVHYAAGYGVDAWGQGTTVTVSS

SEQ ID NO: 158 - protein, 122 aa, Artificial
  An artificially generated sequence
QVQLVESGGGLVQPGRSLRLSCAASGFTFSNAWMHWVRQAPGKGLEWVAQIKDKSQNYATYGAESVKGRFTISRDDSKNSLYLQMNSLKTEDTAVYYCRYVHYAAGYGVDAWGQGTTVTVSS

SEQ ID NO: 159 - protein, 122 aa, Artificial
  An artificially generated sequence
QVQLVESGGGLVQPGRSLRLSCAASGFTFSNAWMHWVRQAPGKGLEWVAQIKDKSQNYATYIAESVKGRFTISRDDSKNSLYLQMNSLKTEDTAVYYCRYVHYAAGYGVDAWGQGTTVTVSS

SEQ ID NO: 160 - protein, 122 aa, Artificial
  An artificially generated sequence
QVQLVESGGGLVQPGRSLRLSCAASGFTFSNAWMHWVRQAPGKGLEWVAQIKDKSQNYATYLAESVKGRFTISRDDSKNSLYLQMNSLKTEDTAVYYCRYVHYAAGYGVDAWGQGTTVTVSS

SEQ ID NO: 161 - protein, 122 aa, Artificial
  An artificially generated sequence
QVQLVESGGGLVQPGRSLRLSCAASGFTFSNAWMHWVRQAPGKGLEWVAQIKDKSQNYATYPAESVKGRFTISRDDSKNSLYLQMNSLKTEDTAVYYCRYVHYAAGYGVDAWGQGTTVTVSS

SEQ ID NO: 162 - protein, 122 aa, Artificial
  An artificially generated sequence
QVQLVESGGGLVQPGRSLRLSCAASGFTFSNAWMHWVRQAPGKGLEWVAQIKDKSQNYATYQAESVKGRFTISRDDSKNSLYLQMNSLKTEDTAVYYCRYVHYAAGYGVDAWGQGTTVTVSS

SEQ ID NO: 163 - protein, 122 aa, Artificial
  An artificially generated sequence
QVQLVESGGGLVQPGRSLRLSCAASGFTFSNAWMHWVRQAPGKGLEWVAQIKDKSQNYATYTAESVKGRFTISRDDSKNSLYLQMNSLKTEDTAVYYCRYVHYAAGYGVDAWGQGTTVTVSS

SEQ ID NO: 164 - protein, 122 aa, Artificial
  An artificially generated sequence
QVQLVESGGGLVQPGRSLRLSCAASGFTFSNAWMHWVRQAPGKGLEWVAQIKDKSQNYATYVAESVKGRFTISRDDSKNSLYLQMNSLKTEDTAVYYCRYVHYAAGYGVDAWGQGTTVTVSS

SEQ ID NO: 165 - protein, 122 aa, Artificial
  An artificially generated sequence
QVQLVESGGGVVQPGRSLKLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSS

SEQ ID NO: 166 - protein, 122 aa, Artificial
  An artificially generated sequence
QVQLVESGGGVVQPGGSLKLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSS

SEQ ID NO: 167 - protein, 122 aa, Artificial
  An artificially generated sequence
QVQLVESGGGVVQPGGSLRLSCAASGFTFSNAWMHWVRQAPGKGLEWVAQIKDKSQNYAQYYAESVKGRFTISRADSKNSIYLQMNSLKTEDTAVYYCRYVHYAAGYGVDIWGQGTTVTVSS

SEQ ID NO: 168 - protein, 122 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSS

SEQ ID NO: 169 - protein, 122 aa, Artificial
  An artificially generated sequence
QVQLVESGGGVVQPGGSLRLSCAASGFTFSNAWMHWVRQAPGKGLEWVAQIKDKSQNYASYYAESVKGRFTISRADSKNSIYLQMNSLKTEDTAVYYCRYVHYAAGYGVDIWGQGTTVTVSS

SEQ ID NO: 170 - protein, 115 aa, Artificial
  An artificially generated sequence
QVQLVQSGAEVKKPGASVKVSCKASGYTFTDYEMHWIRQPPGQGLEWIGAIDGDTPDTAYSQKFKGRVTLTADKSTSTAYMELSSLTSEDTAVYYCTRFYSYTYWGQGTLVTVSS

SEQ ID NO: 171 - protein, 115 aa, Artificial
  An artificially generated sequence
QVQLVQSGAEVKKPGASVKVSCKASGYTFTDYEMHWIRQPPGQGLEWIGAIDGKTPDTAESQKFKGRVTLTADKSTSTAYMELSSLTSEDTAVYYCTRFYSYTYWGQGTLVTVSS

SEQ ID NO: 172 - protein, 115 aa, Artificial
  An artificially generated sequence
QVQLVQSGAEVKKPGASVKVSCKASGYTFTDYEMHWIRQPPGQGLEWIGAIDGKTPDTAYEQKFKGRVTLTADKSTSTAYMELSSLTSEDTAVYYCTRFYSYTYWGQGTLVTVSS

SEQ ID NO: 173 - protein, 115 aa, Artificial
  An artificially generated sequence
QVQLVQSGAEVKKPGASVKVSCKASGYTFTDYEMHWIRQPPGQGLEWIGAIDGKTPDTAYSDKFKGRVTLTADKSTSTAYMELSSLTSEDTAVYYCTRFYSYTYWGQGTLVTVSS

SEQ ID NO: 174 - protein, 115 aa, Artificial
  An artificially generated sequence
QVQLVQSGAEVKKPGASVKVSCKASGYTFTDYEMHWIRQPPGQGLEWIGAIDGETPDTAYSQKFKGRVTLTADKSTSTAYMELSSLTSEDTAVYYCTRFYSYTYWGQGTLVTVSS

SEQ ID NO: 175 - protein, 115 aa, Artificial
  An artificially generated sequence
QVQLVQSGAEVKKPGASVKVSCKASGYTFTDYEMHWIRQPPGQGLEWIGAIDGDTPDTAYEQKFKGRVTLTADKSTSTAYMELSSLTSEDTAVYYCTRFYSYTYWGQGTLVTVSS

SEQ ID NO: 176 - protein, 115 aa, Artificial
  An artificially generated sequence
QVQLVQSGAEVKKPGASVKVSCKASGYTFTDYEMHWIRQPPGQGLEWIGAIDGKTPDTAEEQKFKGRVTLTADKSTSTAYMELSSLTSEDTAVYYCTRFYSYTYWGQGTLVTVSS

SEQ ID NO: 177 - protein, 115 aa, Artificial
  An artificially generated sequence
QVQLVQSGAEVKKPGASVTVSCKASGYTFTDYEMHWIRQPPGQGLEWIGAIDGKTPDTAYEQKFKGRVTLTADKSTSTAYMELSSLTSEDTAVYYCTRFYSYTYWGQGTLVTVSS

SEQ ID NO: 178 - protein, 115 aa, Artificial
  An artificially generated sequence
QVQLVQSGAEVKKPGASVKVSCKASGYTFTDYEMHWIRQPPGEGLEWIGAIDGKTPDTAYEQKFKGRVTLTADKSTSTAYMELSSLTSEDTAVYYCTRFYSYTYWGQGTLVTVSS

SEQ ID NO: 179 - protein, 115 aa, Artificial
  An artificially generated sequence
QVQLVQSGAEVKKPGASVKVSCKASGYTFTDYEMHWIRQPPGQGLEWIGAIDGKTPDTAYEESFKGRVTLTADKSTSTAYMELSSLTSEDTAVYYCTRFYSYTYWGQGTLVTVSS

SEQ ID NO: 180 - protein, 115 aa, Artificial
  An artificially generated sequence
QVQLVQSGAEVKKPGASVKVSCKASGYTFTDYEMHWIRQPPGQGLEWIGAIDGKTPDTAYEQKFQDRVTLTADKSTSTAYMELSSLTSEDTAVYYCTRFYSYTYWGQGTLVTVSS

SEQ ID NO: 181 - protein, 115 aa, Artificial
  An artificially generated sequence
QVQLVQSGAEVKKPGASVTVSCKASGYTFTDYEMHWIRQPPGEGLEWIGAIDGKTPDTAYEQKFKGRVTLTADKSTSTAYMELSSLTSEDTAVYYCTRFYSYTYWGQGTLVTVSS

SEQ ID NO: 182 - protein, 115 aa, Artificial
  An artificially generated sequence
QVQLVQSGAEVKKPGASVTVSCKASGYTFTDYEMHWIRQPPGQGLEWIGAIDGETPDTAYSQKFKGRVTLTADKSTSTAYMELSSLTSEDTAVYYCTRFYSYTYWGQGTLVTVSS

SEQ ID NO: 183 - protein, 115 aa, Artificial
  An artificially generated sequence
QVQLVQSGAEVKKPGASVKVSCKASGYTFTDYEMHWIRQPPGEGLEWIGAIDGETPDTAYSQKFKGRVTLTADKSTSTAYMELSSLTSEDTAVYYCTRFYSYTYWGQGTLVTVSS

SEQ ID NO: 184 - protein, 115 aa, Artificial
  An artificially generated sequence
QVQLVQSGAEVKKPGASVTVSCKASGYTFTDYEMHWIRQPPGEGLEWIGAIDGETPDTAYSQKFKGRVTLTADKSTSTAYMELSSLTSEDTAVYYCTRFYSYTYWGQGTLVTVSS

SEQ ID NO: 185 - protein, 115 aa, Artificial
  An artificially generated sequence
QVQLVQSGAEVKKPGASVKVSCKASGYTFTDYEMHWIRQPPGQGLEWIGAIDGETPDTAYSESFKGRVTLTADKSTSTAYMELSSLTSEDTAVYYCTRFYSYTYWGQGTLVTVSS

SEQ ID NO: 186 - protein, 115 aa, Artificial
  An artificially generated sequence
QVQLVQSGAEVKKPGASVKVSCKASGYEFTDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 187 - protein, 115 aa, Artificial
  An artificially generated sequence
QVQLVQSGAEVKKPGASVKVSCKASGYTFEDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 188 - protein, 115 aa, Artificial
  An artificially generated sequence
QVQLVQSGAEVKKPGASVKVSCKASGYTFTDYEMHWIRQPPGQGLEWIGAIDGKTPDTAYSEKFKGRVTLTADKSTSTAYMELSSLTSEDTAVYYCTRFYSYTYWGQGTLVTVSS

SEQ ID NO: 189 - protein, 115 aa, Artificial
  An artificially generated sequence
QVQLVQSGAEVKKPGASVKVSCKASGYTFTDYEMHWIRQPPGQGLEWIGAIDGKTPDTAYSQKFEGRVTLTADKSTSTAYMELSSLTSEDTAVYYCTRFYSYTYWGQGTLVTVSS

SEQ ID NO: 190 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVELTADKSTSTAYMELSSLTSEDTAVYYCTRFYSYTYWGQGTLVTVSS

SEQ ID NO: 191 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELESLTSEDTAVYYCTRFYSYTYWGQGTLVTVSS

SEQ ID NO: 192 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSELTSEDTAVYYCTRFYSYTYWGQGTLVTVSS

SEQ ID NO: 193 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTEEDTAVYYCTRFYSYTYWGQGTLVTVSS

SEQ ID NO: 194 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDEAVYYCTRFYSYTYWGQGTLVTVSS

SEQ ID NO: 195 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAEYYCTRFYSYTYWGQGTLVTVSS

SEQ ID NO: 196 - protein, 115 aa, Artificial
  An artificially generated sequence
QVQLVQSGAEVKKPGASVTVSCKASGYTFTDYEMHWIRQPPGEGLEWIGAIDGETPDTAYEQKFKGRVTLTADKSTSTAYMELSSLTSEDTAVYYCTRFYSYTYWGQGTLVTVSS

SEQ ID NO: 197 - protein, 115 aa, Artificial
  An artificially generated sequence
QVQLVQSGAEVKKPGASVTVSCKASGYTFTDYEMHWIRQPPGEGLEWIGAIDGETPDTAYSEKFKGRVTLTADKSTSTAYMELSSLTSEDTAVYYCTRFYSYTYWGQGTLVTVSS

SEQ ID NO: 198 - protein, 115 aa, Artificial
  An artificially generated sequence
QVQLVQSGAEVKKPGASVTVSCKASGYTFTDYEMHWIRQPPGEGLEWIGAIDGETPDTAYSDKFKGRVTLTADKSTSTAYMELSSLTSEDTAVYYCTRFYSYTYWGQGTLVTVSS

SEQ ID NO: 199 - protein, 115 aa, Artificial
  An artificially generated sequence
QVQLVQSGAEVKKPGASVTVSCKASGYTFTDYEMHWIRQPPGEGLEWIGAIDGETPDTAYSQKFEGRVTLTADKSTSTAYMELSSLTSEDTAVYYCTRFYSYTYWGQGTLVTVSS

SEQ ID NO: 200 - protein, 115 aa, Artificial
  An artificially generated sequence
QVQLVQSGAEVKKPGASVTVSCKASGYTFTDYEMHWIRQPPGEGLEWIGAIDGETPDTAYSEKFEGRVTLTADKSTSTAYMELSSLTSEDTAVYYCTRFYSYTYWGQGTLVTVSS

SEQ ID NO: 201 - protein, 115 aa, Artificial
  An artificially generated sequence
QVQLVQSGAEVKKPGASVTVSCKASGYTFTDYEMHWIRQPPGEGLEWIGAIDGETPDTAYSQKFEGRVTLTADKSTSTAYMELSSLTEEDTAVYYCTRFYSYTYWGQGTLVTVSS

SEQ ID NO: 202 - protein, 115 aa, Artificial
  An artificially generated sequence
QVQLVQSGAEVKKPGASVTVSCKASGYTFEDYEMHWIRQPPGEGLEWIGAIDGETPDTAYSQKFEGRVTLTADKSTSTAYMELSSLTEEDTAVYYCTRFYSYTYWGQGTLVTVSS

SEQ ID NO: 203 - protein, 115 aa, Artificial
  An artificially generated sequence
QVQLVQSGAEVKKPGASVKVSCKASGYTFTDYEMHWVRQAPGQGLEWIGAIDGKTPDTAYSQKFKGRVTLTADKSTSTAYMELSSLTSEDTAVYYCTRFYSYTYWGQGTLVTVSS

SEQ ID NO: 204 - protein, 115 aa, Artificial
  An artificially generated sequence
QVQLVQSGAEVKKPGASVKVSCKASGYTFTDYEMHWIRQPPGQGLEWMGAIDGKTPDTAYSQKFKGRVTLTADKSTSTAYMELSSLTSEDTAVYYCTRFYSYTYWGQGTLVTVSS

SEQ ID NO: 205 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLRSEDTAVYYCTRFYSYTYWGQGTLVTVSS

SEQ ID NO: 206 - protein, 115 aa, Artificial
  An artificially generated sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSS

SEQ ID NO: 207 - protein, 115 aa, Artificial
  An artificially generated sequence
QVQLVQSGAEVKKPGASVTVSCKASGYTFTDYEMHWIRQPPGEGLEWIGAIDGWTPDTAYSEKFKGRVTLTADKSTSTAYMELSSLTSEDTAVYYCTRFYSYTYWGQGTLVTVSS

SEQ ID NO: 208 - protein, 115 aa, Artificial
  An artificially generated sequence
QVQLVQSGAEVKKPGASVTVSCKASGYTFTDYEMHWIRQPPGEGLEWIGAIDGYTPDTAYSEKFKGRVTLTADKSTSTAYMELSSLTSEDTAVYYCTRFYSYTYWGQGTLVTVSS

SEQ ID NO: 209 - protein, 115 aa, Artificial
  An artificially generated sequence
QVQLVQSGAEVKKPGASVTVSCKASGYTFTDYEMHWIRQPPGEGLEWIGAIDGKTPDTAYSEKFKGRVTLTADKSTSTAYMELSSLTSEDTAVYYCTRFYSYTYWGQGTLVTVSS

SEQ ID NO: 210 - protein, 115 aa, Artificial
  An artificially generated sequence
QVQLVQSGAEVKKPGASVTVSCKASGYTFTDYEMHWIRQPPGEGLEWIGAIDGPTPDTAYSQKFEGRVTLTADKSTSTAYMELSSLTSEDTAVYYCTRFYSYTYWGQGTLVTVSS

SEQ ID NO: 211 - protein, 115 aa, Artificial
  An artificially generated sequence
QVQLVQSGAEVKKPGASVTVSCKASGYTFTDYEMHWVRQAPGEGLEWMGAIDGETPDTAYSEKFKGRVTLTADKSTSTAYMELSSLTSEDTAVYYCTRFYSYTYWGQGTLVTVSS

SEQ ID NO: 212 - protein, 115 aa, Artificial
  An artificially generated sequence
QVQLVQSGAEVKKPGASVTVSCKASGYTFTDYEMHWVRQAPGEGLEWMGAIDGPTPDTAYSEKFKGRVTLTADKSTSTAYMELSSLTSEDTAVYYCTRFYSYTYWGQGTLVTVSS

SEQ ID NO: 213 - protein, 115 aa, Artificial
  An artificially generated sequence
QVQLVQSGAEVKKPGASVTVSCKASGYTFTDYEMHWVRQAPGEGLEWMGAIDGWTPDTAYSEKFKGRVTLTADKSTSTAYMELSSLTSEDTAVYYCTRFYSYTYWGQGTLVTVSS

SEQ ID NO: 214 - protein, 115 aa, Artificial
  An artificially generated sequence
QVQLVQSGAEVKKPGASVTVSCKASGYTFTDYEMHWVRQAPGEGLEWMGAIDGYTPDTAYSEKFKGRVTLTADKSTSTAYMELSSLTSEDTAVYYCTRFYSYTYWGQGTLVTVSS

SEQ ID NO: 215 - protein, 115 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSS

SEQ ID NO: 216 - protein, 112 aa, Artificial
  An artificially generated sequence
DIQMTQSPSSLSASVGDRVTITCRSSQSLVHSNRNTYLHWYQQKPGKAPKLLIYKVSNRFSGVPSRFSGSGSGTDFTFTISSLQPEDIATYYCGQGTQVPYTFGQGTKVEIK

SEQ ID NO: 217 - protein, 112 aa, Artificial
  An artificially generated sequence
DIVMTQSPLSLPVTPGEPASISCRASQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 218 - protein, 112 aa, Artificial
  An artificially generated sequence
DIVMTQSPLSLPVTPGEPASISCRISQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 219 - protein, 112 aa, Artificial
  An artificially generated sequence
DIVMTQSPLSLPVTPGEPASISCRPSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 220 - protein, 112 aa, Artificial
  An artificially generated sequence
DIVMTQSPLSLPVTPGEPASISCRTSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 221 - protein, 112 aa, Artificial
  An artificially generated sequence
DIVMTQSPLSLPVTPGEPASISCRVSQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 222 - protein, 112 aa, Artificial
  An artificially generated sequence
DIVMTQSPLSLPVTPGEPASISCRSPQSLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 223 - protein, 112 aa, Artificial
  An artificially generated sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 224 - protein, 112 aa, Artificial
  An artificially generated sequence
DIVMTQSPLSLPVTPGEPASISCRSSQSFVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 225 - protein, 112 aa, Artificial
  An artificially generated sequence
DIVMTQSPLSLPVTPGEPASISCRSSQSIVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 226 - protein, 112 aa, Artificial
  An artificially generated sequence
DIVMTQSPLSLPVTPGEPASISCRSSQSMVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 227 - protein, 112 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 228 - protein, 112 aa, Artificial
  An artificially generated sequence
DIVMTQSPLSLPVTPGEPASISCRSSQSVVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 229 - protein, 112 aa, Artificial
  An artificially generated sequence
DIVMTQSPLSLPVTPGEPASISCRSSQSLVRSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 230 - protein, 112 aa, Artificial
  An artificially generated sequence
DIVMTQSPLSLPVTPGEPASISCRSSQSLVHFNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 231 - protein, 112 aa, Artificial
  An artificially generated sequence
DIVMTQSPLSLPVTPGEPASISCRSSQSLVHHNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 232 - protein, 112 aa, Artificial
  An artificially generated sequence
DIVMTQSPLSLPVTPGEPASISCRSSQSLVHLNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 233 - protein, 112 aa, Artificial
  An artificially generated sequence
DIVMTQSPLSLPVTPGEPASISCRSSQSLVHMNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 234 - protein, 112 aa, Artificial
  An artificially generated sequence
DIVMTQSPLSLPVTPGEPASISCRSSQSLVHNNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 235 - protein, 112 aa, Artificial
  An artificially generated sequence
DIVMTQSPLSLPVTPGEPASISCRSSQSLVHPNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 236 - protein, 112 aa, Artificial
  An artificially generated sequence
DIVMTQSPLSLPVTPGEPASISCRSSQSLVHQNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 237 - protein, 112 aa, Artificial
  An artificially generated sequence
DIVMTQSPLSLPVTPGEPASISCRSSQSLVHVNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 238 - protein, 112 aa, Artificial
  An artificially generated sequence
DIVMTQSPLSLPVTPGEPASISCRSSQSLVHWNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 239 - protein, 112 aa, Artificial
  An artificially generated sequence
DIVMTQSPLSLPVTPGEPASISCRSSQSLVHSNRDTYLHWYQQKPGQAPRLLIYKVSNRFSGVPDRFSGSGSGTDFTLKISRVEAEDVGVYYCGQGTQVPYTFGQGTKLEIK

SEQ ID NO: 240 - protein, 112 aa, Artificial
  An artificially generated sequence
DIVMTQSPLSLPVTPGEPASISCRSSQSLVHSNRETYLHWYQQKPGQAPRLLIYKVSNRFSGVPDRFSGSGSGTDFTLKISRVEAEDVGVYYCGQGTQVPYTFGQGTKLEIK

SEQ ID NO: 241 - protein, 112 aa, Artificial
  An artificially generated sequence
DIVMTQSPLSLPVTPGEPASISCRSSQSLVHSNRFTYLHWYQQKPGQAPRLLIYKVSNRFSGVPDRFSGSGSGTDFTLKISRVEAEDVGVYYCGQGTQVPYTFGQGTKLEIK

SEQ ID NO: 242 - protein, 112 aa, Artificial
  An artificially generated sequence
DIVMTQSPLSLPVTPGEPASISCRSSQSLVHSNRGTYLHWYQQKPGQAPRLLIYKVSNRFSGVPDRFSGSGSGTDFTLKISRVEAEDVGVYYCGQGTQVPYTFGQGTKLEIK

SEQ ID NO: 243 - protein, 112 aa, Artificial
  An artificially generated sequence
DIVMTQSPLSLPVTPGEPASISCRSSQSLVHSNRHTYLHWYQQKPGQAPRLLIYKVSNRFSGVPDRFSGSGSGTDFTLKISRVEAEDVGVYYCGQGTQVPYTFGQGTKLEIK

SEQ ID NO: 244 - protein, 112 aa, Artificial
  An artificially generated sequence
DIVMTQSPLSLPVTPGEPASISCRSSQSLVHSNRMTYLHWYQQKPGQAPRLLIYKVSNRFSGVPDRFSGSGSGTDFTLKISRVEAEDVGVYYCGQGTQVPYTFGQGTKLEIK

SEQ ID NO: 245 - protein, 112 aa, Artificial
  An artificially generated sequence
DIVMTQSPLSLPVTPGEPASISCRSSQSLVHSNRWTYLHWYQQKPGQAPRLLIYKVSNRFSGVPDRFSGSGSGTDFTLKISRVEAEDVGVYYCGQGTQVPYTFGQGTKLEIK

SEQ ID NO: 246 - protein, 112 aa, Artificial
  An artificially generated sequence
DIVMTQSPLSLPVTPGEPASISCRSSQSLVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 247 - protein, 112 aa, Artificial
  An artificially generated sequence
DIVMTQSPLSLPVTPGEPASISCRSSQSLVHSNRNTYVHWYQQKPGQAPRLLIYKVSNRFSGVPDRFSGSGSGTDFTLKISRVEAEDVGVYYCGQGTQVPYTFGQGTKLEIK

SEQ ID NO: 248 - protein, 112 aa, Artificial
  An artificially generated sequence
DIVMTQSPLSLPVTPGEPASISCRSSQSLVHSNRNTYLEWYQQKPGQAPRLLIYKVSNRFSGVPDRFSGSGSGTDFTLKISRVEAEDVGVYYCGQGTQVPYTFGQGTKLEIK

SEQ ID NO: 249 - protein, 112 aa, Artificial
  An artificially generated sequence
DIVMTQSPLSLPVTPGEPASISCRSSQSLVHSNRNTYLLWYQQKPGQAPRLLIYKVSNRFSGVPDRFSGSGSGTDFTLKISRVEAEDVGVYYCGQGTQVPYTFGQGTKLEIK

SEQ ID NO: 250 - protein, 112 aa, Artificial
  An artificially generated sequence
DIVMTQSPLSLPVTPGEPASISCRSSQSLVHSNRNTYLMWYQQKPGQAPRLLIYKVSNRFSGVPDRFSGSGSGTDFTLKISRVEAEDVGVYYCGQGTQVPYTFGQGTKLEIK

SEQ ID NO: 251 - protein, 112 aa, Artificial
  An artificially generated sequence
DIVMTQSPLSLPVTPGEPASISCRSSQSLVHSNRNTYLNWYQQKPGQAPRLLIYKVSNRFSGVPDRFSGSGSGTDFTLKISRVEAEDVGVYYCGQGTQVPYTFGQGTKLEIK

SEQ ID NO: 252 - protein, 112 aa, Artificial
  An artificially generated sequence
DIVMTQSPLSLPVTPGEPASISCRSSQSLVHSNRNTYLQWYQQKPGQAPRLLIYKVSNRFSGVPDRFSGSGSGTDFTLKISRVEAEDVGVYYCGQGTQVPYTFGQGTKLEIK

SEQ ID NO: 253 - protein, 112 aa, Artificial
  An artificially generated sequence
DIVMTQSPLSLPVTPGEPASISCRSSQSLVHSNRNTYLHWYQQKPGQAPRLLIYKVSFRFSGVPDRFSGSGSGTDFTLKISRVEAEDVGVYYCGQGTQVPYTFGQGTKLEIK

SEQ ID NO: 254 - protein, 112 aa, Artificial
  An artificially generated sequence
DIVMTQSPLSLPVTPGEPASISCRSSQSLVHSNRNTYLHWYQQKPGQAPRLLIYKVSHRFSGVPDRFSGSGSGTDFTLKISRVEAEDVGVYYCGQGTQVPYTFGQGTKLEIK

SEQ ID NO: 255 - protein, 112 aa, Artificial
  An artificially generated sequence
DIVMTQSPLSLPVTPGEPASISCRSSQSLVHSNRNTYLHWYQQKPGQAPRLLIYKVSIRFSGVPDRFSGSGSGTDFTLKISRVEAEDVGVYYCGQGTQVPYTFGQGTKLEIK

SEQ ID NO: 256 - protein, 112 aa, Artificial
  An artificially generated sequence
DIVMTQSPLSLPVTPGEPASISCRSSQSLVHSNRNTYLHWYQQKPGQAPRLLIYKVSMRFSGVPDRFSGSGSGTDFTLKISRVEAEDVGVYYCGQGTQVPYTFGQGTKLEIK

SEQ ID NO: 257 - protein, 112 aa, Artificial
  An artificially generated sequence
DIVMTQSPLSLPVTPGEPASISCRSSQSLVHSNRNTYLHWYQQKPGQAPRLLIYKVSTRFSGVPDRFSGSGSGTDFTLKISRVEAEDVGVYYCGQGTQVPYTFGQGTKLEIK

SEQ ID NO: 258 - protein, 112 aa, Artificial
  An artificially generated sequence
DIVMTQSPLSLPVTPGEPASISCRSSQSLVHSNRNTYLHWYQQKPGQAPRLLIYKVSWRFSGVPDRFSGSGSGTDFTLKISRVEAEDVGVYYCGQGTQVPYTFGQGTKLEIK

SEQ ID NO: 259 - protein, 112 aa, Artificial
  An artificially generated sequence
DIVMTQSPLSLPVTPGEPASISCRSSQSLVHSNRNTYLHWYQQKPGQAPRLLIYKVSNRASGVPDRFSGSGSGTDFTLKISRVEAEDVGVYYCGQGTQVPYTFGQGTKLEIK

SEQ ID NO: 260 - protein, 112 aa, Artificial
  An artificially generated sequence
DIVMTQSPLSLPVTPGEPASISCRSSQSLVHSNRNTYLHWYQQKPGQAPRLLIYKVSNRGSGVPDRFSGSGSGTDFTLKISRVEAEDVGVYYCGQGTQVPYTFGQGTKLEIK

SEQ ID NO: 261 - protein, 112 aa, Artificial
  An artificially generated sequence
DIVMTQSPLSLPVTPGEPASISCRSSQSLVHSNRNTYLHWYQQKPGQAPRLLIYKVSNRISGVPDRFSGSGSGTDFTLKISRVEAEDVGVYYCGQGTQVPYTFGQGTKLEIK

SEQ ID NO: 262 - protein, 112 aa, Artificial
  An artificially generated sequence
DIVMTQSPLSLPVTPGEPASISCRSSQSLVHSNRNTYLHWYQQKPGQAPRLLIYKVSNRKSGVPDRFSGSGSGTDFTLKISRVEAEDVGVYYCGQGTQVPYTFGQGTKLEIK

SEQ ID NO: 263 - protein, 112 aa, Artificial
  An artificially generated sequence
DIVMTQSPLSLPVTPGEPASISCRSSQSLVHSNRNTYLHWYQQKPGQAPRLLIYKVSNRLSGVPDRFSGSGSGTDFTLKISRVEAEDVGVYYCGQGTQVPYTFGQGTKLEIK

SEQ ID NO: 264 - protein, 112 aa, Artificial
  An artificially generated sequence
DIVMTQSPLSLPVTPGEPASISCRSSQSLVHSNRNTYLHWYQQKPGQAPRLLIYKVSNRMSGVPDRFSGSGSGTDFTLKISRVEAEDVGVYYCGQGTQVPYTFGQGTKLEIK

SEQ ID NO: 265 - protein, 112 aa, Artificial
  An artificially generated sequence
DIVMTQSPLSLPVTPGEPASISCRSSQSLVHSNRNTYLHWYQQKPGQAPRLLIYKVSNRNSGVPDRFSGSGSGTDFTLKISRVEAEDVGVYYCGQGTQVPYTFGQGTKLEIK

SEQ ID NO: 266 - protein, 112 aa, Artificial
  An artificially generated sequence
DIVMTQSPLSLPVTPGEPASISCRSSQSLVHSNRNTYLHWYQQKPGQAPRLLIYKVSNRPSGVPDRFSGSGSGTDFTLKISRVEAEDVGVYYCGQGTQVPYTFGQGTKLEIK

SEQ ID NO: 267 - protein, 112 aa, Artificial
  An artificially generated sequence
DIVMTQSPLSLPVTPGEPASISCRSSQSLVHSNRNTYLHWYQQKPGQAPRLLIYKVSNRRSGVPDRFSGSGSGTDFTLKISRVEAEDVGVYYCGQGTQVPYTFGQGTKLEIK

SEQ ID NO: 268 - protein, 112 aa, Artificial
  An artificially generated sequence
DIVMTQSPLSLPVTPGEPASISCRSSQSLVHSNRNTYLHWYQQKPGQAPRLLIYKVSNRVSGVPDRFSGSGSGTDFTLKISRVEAEDVGVYYCGQGTQVPYTFGQGTKLEIK

SEQ ID NO: 269 - protein, 112 aa, Artificial
  An artificially generated sequence
DIVMTQSPLSLPVTPGEPASISCRSSQSLVHSNRNTYLHWYQQKPGQAPRLLIYKVSNRYSGVPDRFSGSGSGTDFTLKISRVEAEDVGVYYCGQGTQVPYTFGQGTKLEIK

SEQ ID NO: 270 - protein, 112 aa, Artificial
  An artificially generated sequence
DIVMTQSPLSLPVTPGEPASISCRSSQSLVHSNRNTYLHWYQQKPGQAPRLLIYKVSNRFFGVPDRFSGSGSGTDFTLKISRVEAEDVGVYYCGQGTQVPYTFGQGTKLEIK

SEQ ID NO: 271 - protein, 112 aa, Artificial
  An artificially generated sequence
DIVMTQSPLSLPVTPGEPASISCRSSQSLVHSNRNTYLHWYQQKPGQAPRLLIYKVSNRFGGVPDRFSGSGSGTDFTLKISRVEAEDVGVYYCGQGTQVPYTFGQGTKLEIK

SEQ ID NO: 272 - protein, 112 aa, Artificial
  An artificially generated sequence
DIVMTQSPLSLPVTPGEPASISCRSSQSLVHSNRNTYLHWYQQKPGQAPRLLIYKVSNRFHGVPDRFSGSGSGTDFTLKISRVEAEDVGVYYCGQGTQVPYTFGQGTKLEIK

SEQ ID NO: 273 - protein, 112 aa, Artificial
  An artificially generated sequence
DIVMTQSPLSLPVTPGEPASISCRSSQSLVHSNRNTYLHWYQQKPGQAPRLLIYKVSNRFIGVPDRFSGSGSGTDFTLKISRVEAEDVGVYYCGQGTQVPYTFGQGTKLEIK

SEQ ID NO: 274 - protein, 112 aa, Artificial
  An artificially generated sequence
DIVMTQSPLSLPVTPGEPASISCRSSQSLVHSNRNTYLHWYQQKPGQAPRLLIYKVSNRFLGVPDRFSGSGSGTDFTLKISRVEAEDVGVYYCGQGTQVPYTFGQGTKLEIK

SEQ ID NO: 275 - protein, 112 aa, Artificial
  An artificially generated sequence
DIVMTQSPLSLPVTPGEPASISCRSSQSLVHSNRNTYLHWYQQKPGQAPRLLIYKVSNRFMGVPDRFSGSGSGTDFTLKISRVEAEDVGVYYCGQGTQVPYTFGQGTKLEIK

SEQ ID NO: 276 - protein, 112 aa, Artificial
  An artificially generated sequence
DIVMTQSPLSLPVTPGEPASISCRSSQSLVHSNRNTYLHWYQQKPGQAPRLLIYKVSNRFPGVPDRFSGSGSGTDFTLKISRVEAEDVGVYYCGQGTQVPYTFGQGTKLEIK

SEQ ID NO: 277 - protein, 112 aa, Artificial
  An artificially generated sequence
DIVMTQSPLSLPVTPGEPASISCRSSQSLVHSNRNTYLHWYQQKPGQAPRLLIYKVSNRFQGVPDRFSGSGSGTDFTLKISRVEAEDVGVYYCGQGTQVPYTFGQGTKLEIK

SEQ ID NO: 278 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 279 - protein, 112 aa, Artificial
  An artificially generated sequence
DIVMTQSPLSLPVTPGEPASISCRSSQSLVHSNRNTYLHWYQQKPGQAPRLLIYKVSNRFVGVPDRFSGSGSGTDFTLKISRVEAEDVGVYYCGQGTQVPYTFGQGTKLEIK

SEQ ID NO: 280 - protein, 112 aa, Artificial
  An artificially generated sequence
DIVMTQSPLSLPVTPGEPASISCRSSQSLVHSNRNTYLHWYQQKPGQAPRLLIYKVSNRFWGVPDRFSGSGSGTDFTLKISRVEAEDVGVYYCGQGTQVPYTFGQGTKLEIK

SEQ ID NO: 281 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 282 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCEQGTQVPYTFGQGTKLEIK

SEQ ID NO: 283 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCFQGTQVPYTFGQGTKLEIK

SEQ ID NO: 284 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCIQGTQVPYTFGQGTKLEIK

SEQ ID NO: 285 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCLQGTQVPYTFGQGTKLEIK

SEQ ID NO: 286 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCNQGTQVPYTFGQGTKLEIK

SEQ ID NO: 287 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 288 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 289 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 290 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQSTQVPYTFGQGTKLEIK

SEQ ID NO: 291 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQTTQVPYTFGQGTKLEIK

SEQ ID NO: 292 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQFPYTFGQGTKLEIK

SEQ ID NO: 293 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQHPYTFGQGTKLEIK

SEQ ID NO: 294 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQNPYTFGQGTKLEIK

SEQ ID NO: 295 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQPPYTFGQGTKLEIK

SEQ ID NO: 296 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQWPYTFGQGTKLEIK

SEQ ID NO: 297 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQYPYTFGQGTKLEIK

SEQ ID NO: 298 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 299 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 300 - protein, 112 aa, Artificial
  An artificially generated sequence
DIVMTQSPLSLPVTPGEPASISCRSSQSPVHSNRWTYLHWYQQKPGQAPRLLIYKVSNRFSGVPDRFSGSGSGTDFTLKISRVEAEDVGVYYCGQGTQVPYTFGQGTKLEIK

SEQ ID NO: 301 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 302 - protein, 112 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 303 - protein, 112 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCGQGTQVPYTFGQGTKLEIK

SEQ ID NO: 304 - protein, 112 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 305 - protein, 112 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 306 - protein, 112 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 307 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 308 - protein, 112 aa, Artificial
  An artificially generated sequence
DIVMTQSPLSLPVTPGEPASISCRSSQSPVHSNRWTYLHWYQQKPGQAPRLLIYKVSNRFSGVPDRFSGSGSGTDFTLKISRVEAEDVGVYYCYQGTQVPYTFGQGTKLEIK

SEQ ID NO: 309 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 310 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 311 - protein, 112 aa, Artificial
  An artificially generated sequence
DIVMTQSPLSLPVTPGEPASISCRSSQSPVHSNRNTYIHWYQQKPGQAPRLLIYKVSNRFRGVPDRFSGSGSGTDFTLKISRVEAEDVGVYYCGQGTQVPYTFGQGTKLEIK

SEQ ID NO: 312 - protein, 112 aa, Artificial
  An artificially generated sequence
DIVMTQSPLSLPVTPGEPASISCRSSQPPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 313 - protein, 112 aa, Artificial
  An artificially generated sequence
DIVMTQSPLSLPVTPGEPASISCRSSQPPVHSNRNTYIHWYQQKPGQAPRLLIYKVSNRFSGVPDRFSGSGSGTDFTLKISRVEAEDVGVYYCGQGTQVPYTFGQGTKLEIK

SEQ ID NO: 314 - protein, 112 aa, Artificial
  An artificially generated sequence
DIVMTQSPLSLPVTPGEPASISCRSSQPLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 315 - protein, 112 aa, Artificial
  An artificially generated sequence
DIVMTQSPLSLPVTPGEPASISCRPSQSLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 316 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 317 - protein, 112 aa, Artificial
  An artificially generated sequence
DIVMTQSPLSLPVTPGEPASISCRSSQSLVHSNRNTYIHWYQQKPGQAPRLLIYKVSNRFRGVPDRFSGSGSGTDFTLKISRVEAEDVGVYYCGQGTQVPYTFGQGTKLEIK

SEQ ID NO: 318 - protein, 112 aa, Artificial
  An artificially generated sequence
DIVMTQSPLSLPVTPGEPASISCRSSQPLVHSNRNTYLHWYQQKPGQAPRLLIYKVSNRFRGVPDRFSGSGSGTDFTLKISRVEAEDVGVYYCYQGTQVPYTFGQGTKLEIK

SEQ ID NO: 319 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCYQGTQVPYTFGQGTKLEIK

SEQ ID NO: 320 - protein, 112 aa, Artificial
  An artificially generated sequence
DIVMTQSPLSLPVTPGEPASISCRSSQSPVHSNRNTYIHWYQQKPGQAPRLLIYKVSNRLSGVPDRFSGSGSGTDFTLKISRVEAEDVGVYYCYQGTQVPYTFGQGTKLEIK

SEQ ID NO: 321 - protein, 112 aa, Artificial
  An artificially generated sequence
DIVMTQSPLSLPVTPGEPASISCRSSQSPVHSNRNTYIHWYQQKPGQAPRLLIYKVSNRFPGVPDRFSGSGSGTDFTLKISRVEAEDVGVYYCYQGTQVPYTFGQGTKLEIK

SEQ ID NO: 322 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCIQGTQVPYTFGQGTKLEIK

SEQ ID NO: 323 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCLQGTQVPYTFGQGTKLEIK

SEQ ID NO: 324 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCVQGTQVPYTFGQGTKLEIK

SEQ ID NO: 325 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQSTQVPYTFGQGTKLEIK

SEQ ID NO: 326 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQTTQVPYTFGQGTKLEIK

SEQ ID NO: 327 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQWPYTFGQGTKLEIK

SEQ ID NO: 328 - protein, 112 aa, Artificial
  An artificially generated sequence
DIVMTQSPLSLPVTPGEPASISCRSSESLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 329 - protein, 112 aa, Artificial
  An artificially generated sequence
DIVMTQSPLSLPVTPGEPASISCRSSQELVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 330 - protein, 112 aa, Artificial
  An artificially generated sequence
DIVMTQSPLSLPVTPGEPASISCRSSQEPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 331 - protein, 112 aa, Artificial
  An artificially generated sequence
DIVMTQSPLSLPVTPGEPASISCRSSQEPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 332 - protein, 112 aa, Artificial
  An artificially generated sequence
DIVMTQSPLSLPVTPGEPASISCRSSQEPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 333 - protein, 112 aa, Artificial
  An artificially generated sequence
DIVMTQSPLSLPVTPGEPASISCRSSQEPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 334 - protein, 112 aa, Artificial
  An artificially generated sequence
DIVMTQSPLSLPVTPGEPASISCRSSEPPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 335 - protein, 112 aa, Artificial
  An artificially generated sequence
DIVMTQSPLSLPVTPGEPASISCRSSESPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 336 - protein, 112 aa, Artificial
  An artificially generated sequence
DIVMTQSPLSLPVTPGEPASISCRSSESPVHSNRNTYLHWYQQKPGQAPRLLIYKVSNRFSGVPDRFSGSGSGTDFTLKISRVEAEDVGVYYCYQGTQVPYTFGQGTKLEIK

SEQ ID NO: 337 - protein, 112 aa, Artificial
  An artificially generated sequence
DIVMTQSPLSLPVTPGEPASISCRSSESPVHSNRNTYLHWYQQKPGQAPRLLIYKVSNRFWGVPDRFSGSGSGTDFTLKISRVEAEDVGVYYCYQGTQVPYTFGQGTKLEIK

SEQ ID NO: 338 - protein, 112 aa, Artificial
  An artificially generated sequence
DIVMTQSPLSLPVTPGEPASISCRSSESPVHSNRNTYIHWYQQKPGQAPRLLIYKVSNRFSGVPDRFSGSGSGTDFTLKISRVEAEDVGVYYCYQGTQVPYTFGQGTKLEIK

SEQ ID NO: 339 - protein, 112 aa, Artificial
  An artificially generated sequence
DIVMTQSPLSLPVTPGEPASISCRSSEPPVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 340 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCSQGTQVPYTFGQGTKLEIK

SEQ ID NO: 341 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCIQGTQVPYTFGQGTKLEIK

SEQ ID NO: 342 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCYQGTQVPYTFGQGTKLEIK

SEQ ID NO: 343 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCSQGTQVPYTFGQGTKLEIK

SEQ ID NO: 344 - protein, 112 aa, Artificial
  An artificially generated sequence
DIVMTQSPLSLPVTPGEPASISCRPSQSPVHSNRNTYIQWYQQKPGQAPRLLIYKVSNRFSGVPDRFSGSGSGTDFTLKISRVEAEDVGVYYCIQGTQVPYTFGQGTKLEIK

SEQ ID NO: 345 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 346 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCTQGTQVPYTFGQGTKLEIK

SEQ ID NO: 347 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCTQGTQVPYTFGQGTKLEIK

SEQ ID NO: 348 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCTQGTQVPYTFGQGTKLEIK

SEQ ID NO: 349 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 350 - protein, 112 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCAQGTQVPYTFGQGTKLEIK

SEQ ID NO: 351 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCAQGTQVPYTFGQGTKLEIK

SEQ ID NO: 352 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCAQGTQVPYTFGQGTKLEIK

SEQ ID NO: 353 - protein, 112 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 354 - protein, 112 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCVQGTQVPYTFGQGTKLEIK

SEQ ID NO: 355 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCVQGTQVPYTFGQGTKLEIK

SEQ ID NO: 356 - protein, 112 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCGQGTQVPYTFGQGTKLEIK

SEQ ID NO: 357 - protein, 112 aa, Artificial
  An artificially generated sequence
DIVMTQSPLSLPVTPGEPASISCRSSQSLVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 358 - protein, 112 aa, Artificial
  An artificially generated sequence
DIVMTQSPLSLPVTPGEPASISCRSSQPPVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 359 - protein, 112 aa, Artificial
  An artificially generated sequence
DIVMTQSPLSLPVTPGEPASISCRSSQPLVHSNRQTYLHWYQQKPGQAPRLLIYKVSNRFSGVPDRFSGSGSGTDFTLKISRVEAEDVGVYYCGQGTQVPYTFGQGTKLEIK

SEQ ID NO: 360 - protein, 112 aa, Artificial
  An artificially generated sequence
DIVMTQSPLSLPVTPGEPASISCQASESLVHSNRNTYLHWYQQKPGQAPRLLIYKVSNRFSGVPDRFSGSGSGTDFTLKISRVEAEDVGVYYCGQGTQVPYTFGQGTKLEIK

SEQ ID NO: 361 - protein, 112 aa, Artificial
  An artificially generated sequence
DIVMTQSPLSLPVTPGEPASISCRSSQSLVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 362 - protein, 112 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKVEIE

SEQ ID NO: 363 - protein, 112 aa, Artificial
  An artificially generated sequence
DIVMTQSPLSLPVTPGEPASISCQASESLVHSNRNTYLHWYQQKPGQAPRLLIYKVSNRFSGVPDRFSGSGSGTDFTLKISRVEAEDVGVYYCGQGTQVPYTFGQGTKVEIE

SEQ ID NO: 364 - protein, 112 aa, Artificial
  An artificially generated sequence
DIVMTQSPLSLPVTPGEPASISCRSSQSLVHSNRNTYLHWYLQKPGQSPQLLIYKVSNRFSGVPDRFSGSGSGTDFTLKISRVEAEDVGVYYCGQGTQVPYTFGQGTKVEIE

SEQ ID NO: 365 - protein, 112 aa, Artificial
  An artificially generated sequence
DIVMTQSPLSLPVTPGEPASISCQASESLVHSNRNTYLHWYLQKPGQSPQLLIYKVSNRFSGVPDRFSGSGSGTDFTLKISRVEAEDVGVYYCGQGTQVPYTFGQGTKVEIE

SEQ ID NO: 366 - protein, 112 aa, Artificial
  An artificially generated sequence
DIVMTQSPLSLPVTPGEPASISCQASESLVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 367 - protein, 112 aa, Artificial
  An artificially generated sequence
DIVMTQSPLSLPVTPGEPASISCQASESLVHSNRNTYLHWYQQKPGQAPRLLIYKVSNRFRGVPDRFSGSGSGTDFTLKISRVEAEDVGVYYCGQGTQVPYTFGQGTKLEIK

SEQ ID NO: 368 - protein, 112 aa, Artificial
  An artificially generated sequence
DIVMTQSPLSLPVTPGEPASISCRSSQSLVHSNRNTYLHWYLQKPGQSPQLLIYKVSNRFRGVPDRFSGSGSGTDFTLKISRVEAEDVGVYYCGQGTQVPYTFGQGTKLEIK

SEQ ID NO: 369 - protein, 112 aa, Artificial
  An artificially generated sequence
DIVMTQSPLSLPVTPGEPASISCRSSQSLVHSNRNTYLHWYQQKPGQAPRLLIYKVSNRFRGVPDRFSGSGSGTDFTLKISRVEAEDVGVYYCGQGTQVPYTFGQGTKVEIE

SEQ ID NO: 370 - protein, 112 aa, Artificial
  An artificially generated sequence
DIVMTQSPLSLPVTPGEPASISCQASESLVHSNRNTYLHWYQQKPGQAPRLLIYKVSNRFRGVPDRFSGSGSGTDFTLKISRVEAEDVGVYYCGQGTQVPYTFGQGTKVEIE

SEQ ID NO: 371 - protein, 112 aa, Artificial
  An artificially generated sequence
DIVMTQSPLSLPVTPGEPASISCRSSQSLVHSNRNTYLHWYLQKPGQSPQLLIYKVSNRFRGVPDRFSGSGSGTDFTLKISRVEAEDVGVYYCGQGTQVPYTFGQGTKVEIE

SEQ ID NO: 372 - protein, 112 aa, Artificial
  An artificially generated sequence
DIVMTQSPLSLPVTPGEPASISCQASESLVHSNRNTYLHWYLQKPGQSPQLLIYKVSNRFRGVPDRFSGSGSGTDFTLKISRVEAEDVGVYYCGQGTQVPYTFGQGTKVEIE

SEQ ID NO: 373 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 374 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCYQGTQVPYTFGQGTKLEIK

SEQ ID NO: 375 - protein, 112 aa, Artificial
  An artificially generated sequence
DIVMTQSPLSLPVTPGEPASISCRSSQSPVHSNRNTYIQWYLQKPGQSPQLLIYKVSNRFSGVPDRFSGSGSGTDFTLKISRVEAEDVGVYYCYQGTQVPYTFGQGTKLEIK

SEQ ID NO: 376 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCGQGTQVPYTFGQGTKLEIK

SEQ ID NO: 377 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCYQGTQVPYTFGQGTKLEIK

SEQ ID NO: 378 - protein, 112 aa, Artificial
  An artificially generated sequence
DIVMTQSPLSLPVTPGEPASISCQASESPVHSNRNTYIQWYLQKPGQSPQLLIYKVSNRFSGVPDRFSGSGSGTDFTLKISRVEAEDVGVYYCYQGTQVPYTFGQGTKLEIK

SEQ ID NO: 379 - protein, 112 aa, Artificial
  An artificially generated sequence
DIVMTQSPLSLPVTPGEPASISCRSSQSPVHSNRNTYLHWYLQKPGQSPQLLIYKVSNRFSGVPDRFSGSGSGTDFTLKISRVEAEDVGVYYCTQGTQVPYTFGQGTKLEIK

SEQ ID NO: 380 - protein, 112 aa, Artificial
  An artificially generated sequence
DIVMTQSPLSLPVTPGEPASISCQASESPVHSNRNTYLHWYLQKPGQSPQLLIYKVSNRFSGVPDRFSGSGSGTDFTLKISRVEAEDVGVYYCTQGTQVPYTFGQGTKLEIK

SEQ ID NO: 381 - protein, 458 aa, Artificial
  An artificially generated sequence
QVQLVESGGGVVQPGRSLRLSCAASGFTFSNAWMHWVRQAPGKGLEWVANIKAKSNNYATYYAESVKGRFTISRDDSKNSLYLQMNSLKTEDTAVYYCRYVHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 382 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVQAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 383 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 384 - protein, 440 aa, Artificial
  An artificially generated sequence
QVQLVQSGAEVKKPGASVTVSCKASGYTFTDYEMHWIRQPPGEGLEWIGAIDGETPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 385 - protein, 440 aa, Artificial
  An artificially generated sequence
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 386 - protein, 440 aa, Artificial
  An artificially generated sequence
QVQLVQSGAEVKKPGASVTVSCKASGYTFTDYEMHWVRQAPGEGLEWMGAIDGETPDTAYSEKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 387 - protein, 440 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 388 - protein, 458 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 389 - protein, 458 aa, Artificial; identical to SEQ ID NO: 49
  An artificially generated sequence

SEQ ID NO: 390 - protein, 447 aa, Artificial
  An artificially generated sequence
EVQLVETGGSLVQPGKSLKLTCATSGFTFSNAWMHWVRQSPEKQLEWVAQIKAKSNNYATYYAESVKGRFTISRDDSKSNIYLQMNSLKEEDTAVYYCRYVHYGAYYGVDAWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 391 - protein, 458 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVQAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 392 - protein, 458 aa, Artificial
  An artificially generated sequence
QVQLVESGGGLVQPGRSLRLSCAASGFTFSNAWMHWVRQAPGKGLEWVAQIKGKSNNYATYYAESVKGRFTISRADSKNSIYLQMNSLKTEDTAVYYCRYVHYSASYGVDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSPDYKDDDDK

SEQ ID NO: 393 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYSASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 394 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRADSKNSIYLQMNSLKTEDTAVYYCRYVHYAASYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 395 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 396 - protein, 447 aa, Artificial
  An artificially generated sequence
QVQLVESGGGVVQPGGSLRLSCAASGFTFSNAWMHWVRQAPGKGLEWVAQIKDKSQNYATYYAESVKGRFTISRDDSKNSLYLQMNSLKTEDTAVYYCRYVHYAASYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 397 - protein, 447 aa, Artificial
  An artificially generated sequence
QVQLVESGGGLVQPGRSLRLSCAASGFTFSNAWMHWVRQAPGKGLEWVAQIKDKSNNYATYYAESVKGRFTISRADSKNSIYLQMNSLKTEDTAVYYCRYVHYAASYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 398 - protein, 447 aa, Artificial
  An artificially generated sequence
QVQLVESGGGLVQPGRSLRLSCAASGFTFSNAWMHWVRQAPGKGLEWVAQIKDKSQNYATYYAESVKGRFTISRDDSKNSLYLQMNSLKTEDTAVYYCRYVHYAAGYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 399 - protein, 447 aa, Artificial
  An artificially generated sequence
QVQLVESGGGVVQPGGSLRLSCAASGFTFSNAWMHWVRQAPGKGLEWVAQIKDKSQNYATYYAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 400 - protein, 447 aa, Artificial
  An artificially generated sequence
QVQLVESGGGLVQPGRSLRLSCAASGFTFSNAWMHWVRQAPGKGLEWVAQIKDKSQNYATYVAESVKGRFTISRDDSKNSLYLQMNSLKTEDTAVYYCRYVHYAAGYGVDAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 401 - protein, 447 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 402 - protein, 447 aa, Artificial
  An artificially generated sequence
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFRGGPKVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 403 - protein, 450 aa, Artificial; identical to SEQ ID NO: 47
  An artificially generated sequence

SEQ ID NO: 404 - protein, 450 aa, Artificial
  An artificially generated sequence
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIKSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSPHHHHHHHH

SEQ ID NO: 405 - protein, 222 aa, Artificial; identical to SEQ ID NO: 48
  An artificially generated sequence

SEQ ID NO: 406 - protein, 222 aa, Artificial
  An artificially generated sequence
QVQLVQSGAEVKKPGASVKVSCKASGYTFTDYEMHWIRQPPGQGLEWIGAIDGKTPDTAYSQKFKGRVTLTADKSTSTAYMELSSLTSEDTAVYYCTRFYSYTYWGQGTLVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 407 - protein, 219 aa, Artificial; identical to SEQ ID NO: 50
  An artificially generated sequence

SEQ ID NO: 408 - protein, 219 aa, Artificial
  An artificially generated sequence
DIVMTQSPLSLPVTPGEPASISCRSSQSLVHSNRNTYLSWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 219 aa, Artificial; identical to SEQ ID NO: 56
  An artificially generated sequence

SEQ ID NO: 410 - protein, 219 aa, Artificial
  An artificially generated sequence
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 411 - protein, 219 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 412 - protein, 219 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 413 - protein, 219 aa, Artificial
  An artificially generated sequence
DIVMTQSPLSLPVTPGEPASISCRSSQSPVHSNRNTYLHWYQQKPGQAPRLLIYKVSNRFRGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 414 - protein, 219 aa, Artificial
  An artificially generated sequence
DIVMTQSPLSLPVTPGEPASISCRSSQSPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 415 - protein, 219 aa, Artificial
  An artificially generated sequence
DIVMTQSPLSLPVTPGEPASISCRSSQSPVHSNRNTYLHWYQQKPGQAPRLLIYKVSNRFWGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 416 - protein, 219 aa, Artificial
  An artificially generated sequence
DIVMTQSPLSLPVTPGEPASISCRSSQSPVHSNRNTYIHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 219 aa, Artificial
  An artificially generated sequence
DIVMTQSPLSLPVTPGEPASISCRSSQPPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 418 - protein, 219 aa, Artificial
  An artificially generated sequence
DIVMTQSPLSLPVTPGEPASISCRPSQSPVHSNRNTYLHWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 219 aa, Artificial
  An artificially generated sequence
DIVMTQSPLSLPVTPGEPASISCRSSQSPVHSNRNTYIQWYQQKPGQAPRLLIYKVSNRFSGVPDRFSGSGSGTDFTLKISRVEAEDVGVYYCYQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 420 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVQAWGQGTTVTVSS

SEQ ID NO: 421 - protein, 122 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVQAWGQGTTVTVSS

SEQ ID NO: 422 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRRVHYGAYYGVDAWGQGTTVTVSS

SEQ ID NO: 423 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRRVHYYYYYGVDAWGQGTTVTVSS

SEQ ID NO: 424 - protein, 122 aa, Artificial; identical to SEQ ID NO: 42
  An artificially generated sequence

SEQ ID NO: 425 - protein, 122 aa, Artificial
  An artificially generated sequence
QVQLVESGGGVVQPGRSLRLSCAASGFTFSNAWMHWVRQAPGKGLEWVALIKAKSNNYATYYAESVKGRFTISRDDSKNSLYLQMNSLKTEDTAVYYCRYVHYGAYYGVDAWGQGTTVTVSS

SEQ ID NO: 426 - protein, 122 aa, Artificial
  An artificially generated sequence
QVQLVESGGGVVQPGRSLRLSCAASGFTFSNAWMHWVRQAPGKGLEWVANIKAKSNNYATYYAESVKGRFTISRDDSKNSLYLQMNSLKTEDTAVYYCRYVHYGAYYGVDAWGQGTTVTVSS

SEQ ID NO: 427 - protein, 122 aa, Artificial
  An artificially generated sequence
QVQLVESGGGVVQPGRSLRLSCAASGFTFSNAWMHWVRQAPGKGLEWVAQIKALSNNYATYYAESVKGRFTISRDDSKNSLYLQMNSLKTEDTAVYYCRYVHYGAYYGVDAWGQGTTVTVSS

SEQ ID NO: 428 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVDAWGQGTTVTVSS

SEQ ID NO: 429 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYAYYGVQAWGQGTTVTVSS

SEQ ID NO: 430 - protein, 122 aa, Artificial
  An artificially generated sequence
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYVHYYYYYGVDAWGQGTTVTVSS

SEQ ID NO: 431 - protein, 122 aa, Artificial
  An artificially generated sequence
QVQLVESGGGVVQPGRSLRLSCAASGFTFSNAWMHWVRQAPGKGLEWVAQIKAKSNNYKKYYAESVKGRFTISRDDSKNSLYLQMNSLKTEDTAVYYCRYVHYYYYYGVDAWGQGTTVTVSS

SEQ ID NO: 432 - protein, 107 aa, Artificial
  An artificially generated sequence
ASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

The invention claimed is:

1. A multispecific antigen-binding molecule that comprises a glypican 3 binding domain and a T-cell receptor complex-binding domain, wherein:
   (1) the glypican 3 binding domain comprises (i) a heavy chain (H-chain) variable region comprising complementarity determining region (CDR) 1, CDR2, and CDR3 sequences of an H-chain having an amino acid sequence of SEQ ID NO:206 and (ii) a light chain (L-chain) variable region comprising CDR1, CDR2, and CDR3 sequences of an L-chain having an amino acid sequence of SEQ ID NO:223; and
   (2) the T-cell receptor complex-binding domain comprises (i) a H-chain variable region comprises CDR1, CDR2, and CDR3 sequences of an H-chain having an amino acid sequence of SEQ ID NO:168 and (ii) an L-chain variable region comprising CDR1, CDR2, and CDR3sequences of an L-chain having an amino acid sequence of SEQ ID NO:223.

2. The multispecific antigen-binding molecule of claim 1, further comprising a domain comprising an Fc region, wherein the Fc region comprises a mutation in an amino acid sequence selected from the group consisting of SEQ ID NO:23, SEQ ID NO:24, SEQ ID NO:25, and SEQ ID NO:26.

3. The multispecific antigen-binding molecule of claim 2, wherein the Fc region comprises a mutation in at least one amino acid residue position selected from the following positions specified by EU numbering:
   position 220, position 226, position 229, position 231, position 232, position 233, position 234, position 235, position 236, position 237, position 238, position 239, position 240, position 264, position 265, position 266, position 267, position 269, position 270, position 295, position 296, position 297, position 298, position 299, position 300, position 325, position 327, position 328, position 329, position 330, position 331, and position 332.

4. The multispecific antigen-binding molecule of claim 2, wherein the Fc region comprises a mutation in at least one amino acid residue selected from the following amino acid residue positions specified by EU numbering:
   Arg at amino acid position 234, Ala or Arg at amino acid position 235, Lys at amino acid position 239, and Ala at amino acid position 297.

5. The multispecific antigen-binding molecule of claim 2, wherein the Fc region further comprises an amino acid mutation that promotes formation of a heterodimeric Fc region.

6. The multispecific antigen-binding molecule of claim 5, wherein the heterodimeric Fc region comprises a combination selected from the group consisting of:
   (1) a first Fc that comprises the amino acid sequence of SEQ ID NO:57, and a second Fc that comprises the amino acid sequence of SEQ ID NO:58; and
   (2) a first Fc that comprises the amino acid sequence of SEQ ID NO:60 or 62, and a second Fc that comprises the amino acid sequence of SEQ ID NO:61.

7. The multispecific antigen-binding molecule of claim 1, which is a bispecific antibody.

8. The multispecific antigen-binding molecule of claim 1, wherein:
   (1) the glypican 3 binding domain comprises (i) an H-chain variable region comprising the amino acid sequence of SEQ ID NO:206 and (ii) an L-chain variable region comprising the amino acid sequence of SEQ ID NO:223; and
   (2) the T-cell receptor complex-binding domain comprises (i) an H-chain variable region comprising the amino acid sequence of SEQ ID NO:168 and (ii) an L-chain variable region comprising the amino acid sequence of SEQ ID NO:223.

9. The multispecific antigen-binding molecule of claim 1, further comprising a domain comprising an Fc region.

10. A bispecific antibody comprising a glypican 3 binding domain and a T-cell receptor complex-binding domain, wherein:
   (1) the glypican 3 binding domain comprises (i) an H-chain variable region comprising the amino acid sequence of SEQ ID NO:206, (ii) an H-chain constant region comprising the amino acid sequence of SEQ ID NO:61, (iii) an L-chain variable region comprising the amino acid sequence of SEQ ID NO:223, and (iv) an L-chain constant region comprising the amino acid sequence of SEQ ID NO:63; and
   (2) the T-cell receptor complex-binding domain comprises (i) an H-chain variable region comprising the amino acid sequence of SEQ ID NO:168, (ii) an H-chain constant region comprising the amino acid sequence of SEQ ID NO:62, (iii) an L-chain variable region comprising the amino acid sequence of SEQ ID NO:223, and (iv) an L-chain constant region comprising the amino acid sequence of SEQ ID NO:63.

* * * * *